US009528123B2

(12) United States Patent
Raemaekers et al.

(10) Patent No.: US 9,528,123 B2
(45) Date of Patent: *Dec. 27, 2016

(54) DSRNA AS INSECT CONTROL AGENT

(71) Applicant: DEVGEN N.V., Zwijnaarde (BE)

(72) Inventors: Romaan Raemaekers, De Pinte (BE); Laurent Kubler, Beynost (FR); Els Vanbleu, Berlare (BE); Thierry Andre Olivier Eddy Bogaert, Kortrijk (BE)

(73) Assignee: Devgen NV (BE)

( * ) Notice: Subject to any disclaimer, the term of this patent is extended or adjusted under 35 U.S.C. 154(b) by 0 days.

This patent is subject to a terminal disclaimer.

(21) Appl. No.: 14/470,868

(22) Filed: Aug. 27, 2014

(65) Prior Publication Data

US 2014/0373197 A1    Dec. 18, 2014

Related U.S. Application Data

(62) Division of application No. 12/087,536, filed as application No. PCT/EP2007/000286 on Jan. 12, 2007, now abandoned.

(60) Provisional application No. 60/875,356, filed on Dec. 18, 2006, provisional application No. 60/837,910, filed on Aug. 16, 2006, provisional application No. 60/771,160, filed on Feb. 7, 2006, provisional application No. 60/758,191, filed on Jan. 12, 2006.

(51) Int. Cl.
| | |
|---|---|
| *C12N 15/82* | (2006.01) |
| *A01N 57/16* | (2006.01) |
| *A01N 61/00* | (2006.01) |
| *C07K 14/435* | (2006.01) |
| *C12N 15/113* | (2010.01) |

(52) U.S. Cl.
CPC ........... *C12N 15/8286* (2013.01); *A01N 57/16* (2013.01); *A01N 61/00* (2013.01); *C07K 14/4354* (2013.01); *C07K 14/43527* (2013.01); *C12N 15/113* (2013.01); *C12N 15/8282* (2013.01); *C12N 15/8285* (2013.01); *C12N 2310/14* (2013.01)

(58) Field of Classification Search
None
See application file for complete search history.

(56) References Cited

U.S. PATENT DOCUMENTS

| | | |
|---|---|---|
| 6,703,491 B1 | 3/2004 | Homburger et al. |
| 2003/0150017 A1 | 8/2003 | Mesa et al. |
| 2005/0287570 A1 | 12/2005 | Mounts |
| 2006/0021087 A1 | 1/2006 | Baum et al. ............ 800/279 |
| 2006/0272049 A1 | 11/2006 | Waterhouse et al. ...... 800/279 |
| 2008/0113351 A1 | 5/2008 | Naito et al. |
| 2009/0285784 A1 | 11/2009 | Raemaekers et al. |

FOREIGN PATENT DOCUMENTS

| | | |
|---|---|---|
| WO | 99/32619 A1 | 7/1999 |
| WO | 99/53050 A1 | 10/1999 |
| WO | 00/01846 A2 | 1/2000 |
| WO | WO 00/55376 A1 | 9/2000 |
| WO | WO 01/09301 A2 | 2/2001 |
| WO | 01/34815 A1 | 5/2001 |
| WO | 01/37654 A2 | 5/2001 |
| WO | WO 01/71042 A2 | 9/2001 |
| WO | 01/88121 A1 | 11/2001 |
| WO | 02/46432 A2 | 6/2002 |
| WO | 03/004644 A1 | 1/2003 |
| WO | 2004/001013 A2 | 12/2003 |
| WO | 2005/019408 A2 | 3/2005 |
| WO | 2005/047300 A2 | 5/2005 |
| WO | 2005/049841 A1 | 6/2005 |
| WO | 2005/110068 A2 | 11/2005 |
| WO | WO 2005/116204 A1 | 12/2005 |
| WO | WO 2007/083193 A2 | 7/2007 |

OTHER PUBLICATIONS

Stapleton et al (2003). Accession No. AY069131; deposited Jan. 2003.*
Genbank Submission; NCBI; Accession No. ABL02283. Newton et al.; Nov. 19, 2010.
Genbank Submission; NCBI; Accession No. AM106685. Dillon et al.; Dec. 23, 2005.
Genbank Submission; NCBI; Accession No. AR508074. Homburger et al.; Sep. 22, 2004.
Genbank Submission; NCBI; Accession No. BT001619. Stapleton et al.; Nov. 15, 2002.
Genbank Submission; NCBI; Accession No. CB602554. Srinivasan et al.; Apr. 4, 2003.
Genbank Submission; NCBI; Accession No. CK811880. Siviero et al.; Dec. 1, 2004.
Genbank Submission; NCBI; Accession No. DN200332. Hunter et al.; Feb. 25, 2005.
Genbank Submission; NCBI; Accession No. FW658194. Naito et al.; Apr. 18, 2001.
Baumann et al., Sequence analysis of DNA fragments from the genome of the primary endosymbiont of the whitefly *Bemisia tabaci*. Curr Microbiol. Jan. 2004;48(1):77-81.
Roberts et al., Loss of SEC-23 in Caenorhabditis elegans causes defects in oogenesis, morphogenesis, and extracellular matrix secretion. Mol Biol Cell. Nov. 2003;14(11):4414-26. Epub Aug. 7, 2003.
Robertson et al., Diversity of odourant binding proteins revealed by an expressed sequence tag project on male *Manduca sexta* moth antennae. Insect Mol Biol. Nov. 1999;8(4):501-18.
Severson et al., Linkage map organization of expressed sequence tags and sequence tagged sites in the mosquito, *Aedes aegypti*. Insect Mol Biol. Aug. 2002;11(4):371-8.

(Continued)

*Primary Examiner* — Medina A Ibrahim
(74) *Attorney, Agent, or Firm* — Yoshimi D. Barron

(57) ABSTRACT

The present invention relates to methods for controlling pest infestation using double stranded RNA molecules. The invention provides methods for making transgenic plants that express the double stranded RNA molecules, as well as pesticidal agents and commodity products produced by the inventive plants.

30 Claims, 16 Drawing Sheets

(56) References Cited

OTHER PUBLICATIONS

Soares et al., Capillary feeding of specific dsRNA induces silencing of the isac gene in ymphal *Ixodes scapularis* ticks. Insect Mol Biol. Aug. 2005;14(4):443-52.

Timmons et al., Ingestion of bacterially expressed dsRNAs can produce specific and potent genetic interference in Caenorhabditis elegans. Gene. Jan. 24, 2001;263(1-2):103-12.

Zhu et al., Ingested RNA interference for managing the populations of the Colorado potato beetle, *Leptinotarsa decemlineata*. Pest Manag Sci. Feb. 2011;67(2):175-82. Epub Nov. 8, 2010.

Genbank Submission; NCBI, Accession No. AM048926; Longhorn; Jul. 16, 2005.

Genbank Submission; NCBI, Accession No. Q4GXU7; Longhorn et al.; Nov. 28, 2006.

Clough et al., Floral dip: a simplified method for Agrobacterium-mediated transformation of Arabidopsis thaliana. Plant J. Dec. 1998;16(6):735-43.

Febvay et al., Influence of the amino acid balance on the improvement of an artificial diet for a biotype of Acyrthosiphon pisum (Homoptera: Aphididae). Can. J. Zool. 1988;66(11):2449-2453.

Fire, RNA-triggered gene silencing. TIG. Sep. 1999;15(9):358-63.

Koyama, Artificial rearing and nutritional physiology of the planthoppers and leafhoppers (Hemiptera: Delphacidae and Deltocephalidae) on a holidic diet. Japan Agricultural Research Quarterly. 1988;22(1):20-27.

Rice et al., EMBOSS: the European Molecular Biology Open Software Suite. TIG. Jun. 2000;16(6):276-7.

Sharp, RNA interference—2001. Genes Dev. Mar. 1, 2001;15(5):485-90.

Whyard et al., Ingested double-stranded RNAs can act as species-specific insecticides. Insect Biochem Mol Biol. Nov. 2009;39(11):824-32. Epub Oct. 6, 2009.

Thomas et al. The Plant Journal (2001) 25(4), pp. 417-425.

Genbank Submission; NCBI; Accession No. CO334556, 2004.

Hamada et al., Effects on RNA interference in gene expression (RNAi) in cultured mammalian cells of mismatches and the introduction of chemical modifications at the 3'-ends of siRNAs. Antisense Nucleic Acid Drug Dev. Oct. 2002;12(5):301-9.

Qiu et al., A computational study of off-target effects of RNA interference. Nucleic Acids Res. Mar. 30, 2005;33(6):1834-47.

\* cited by examiner

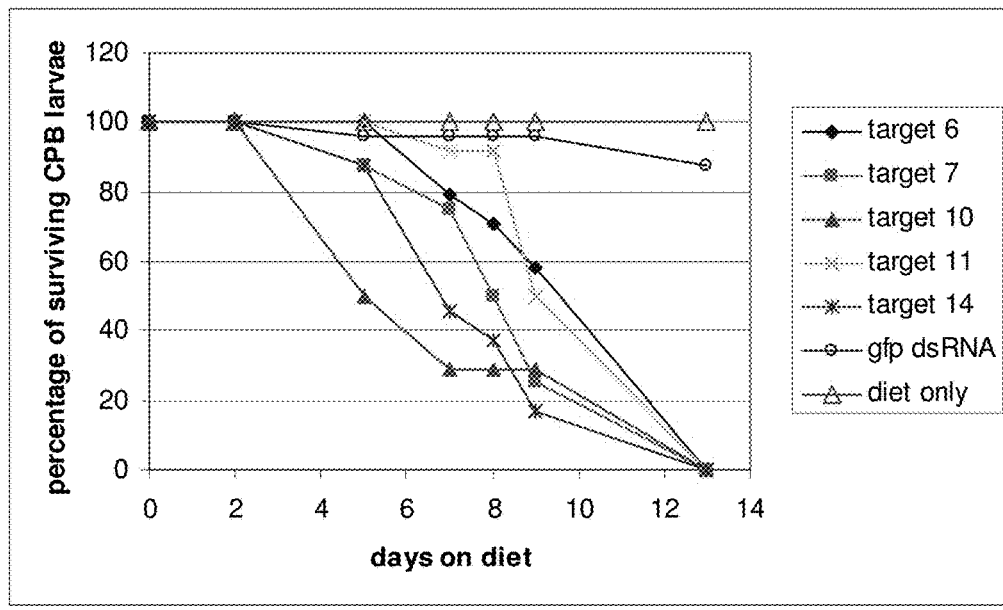
FIGURE 1-LD
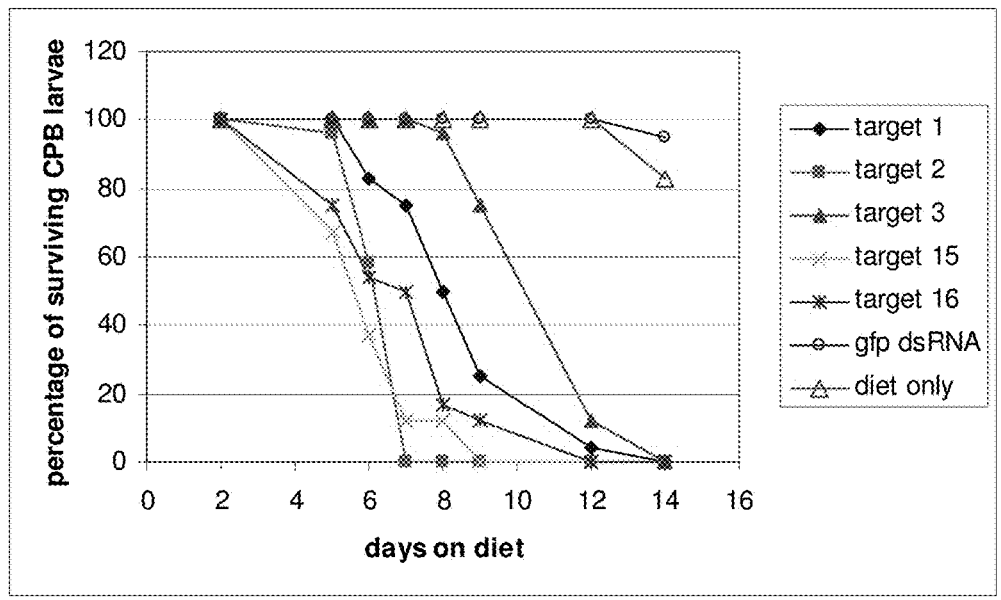
FIGURE 2-LD

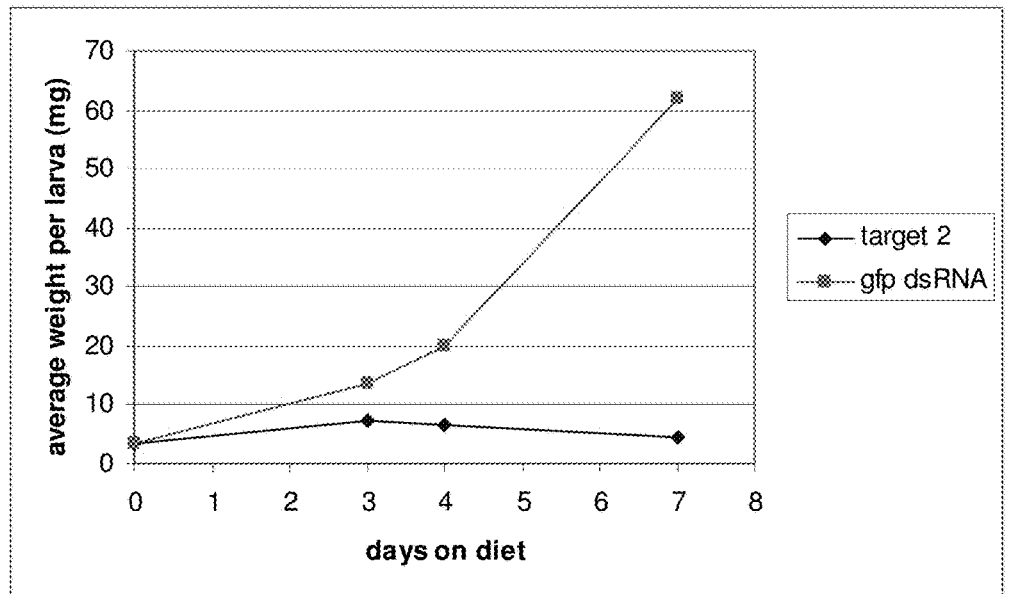
FIGURE 3-LD
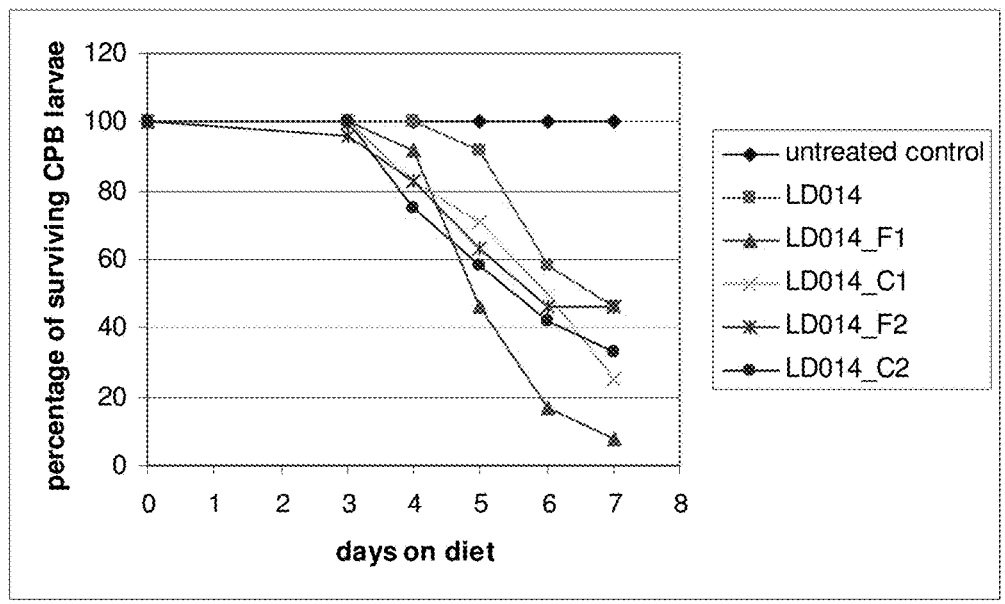
FIGURE 4-LD

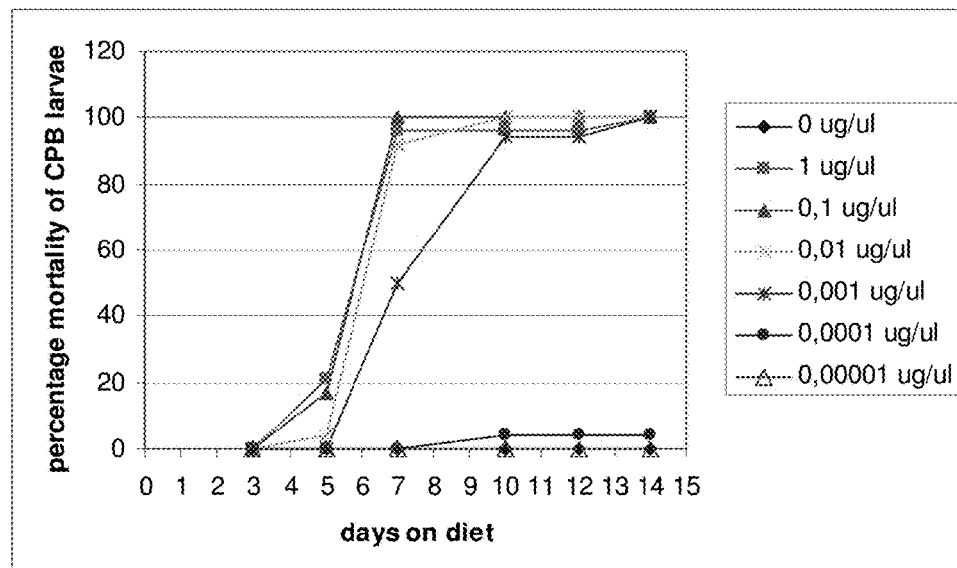
FIGURE 5-LD (a)
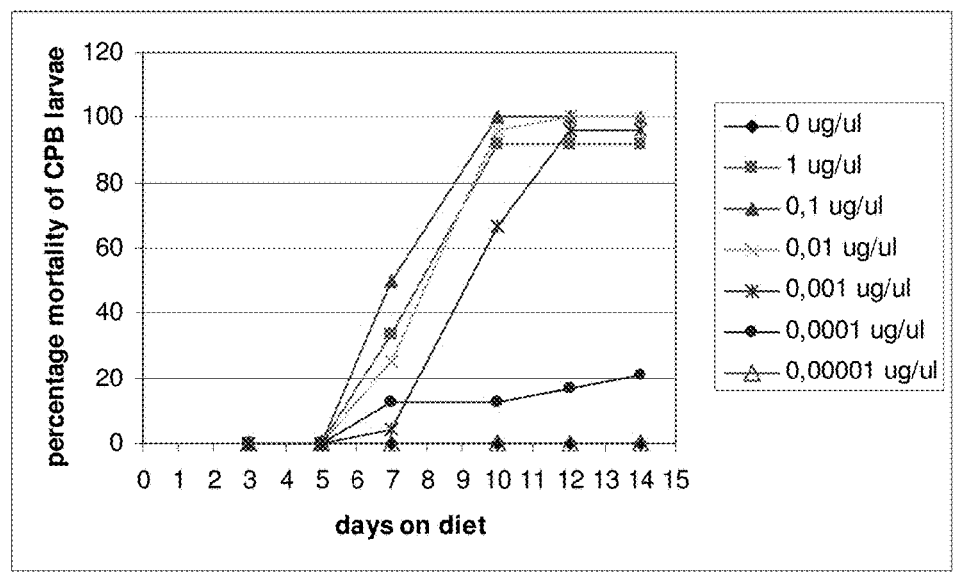
FIGURE 5-LD (b)

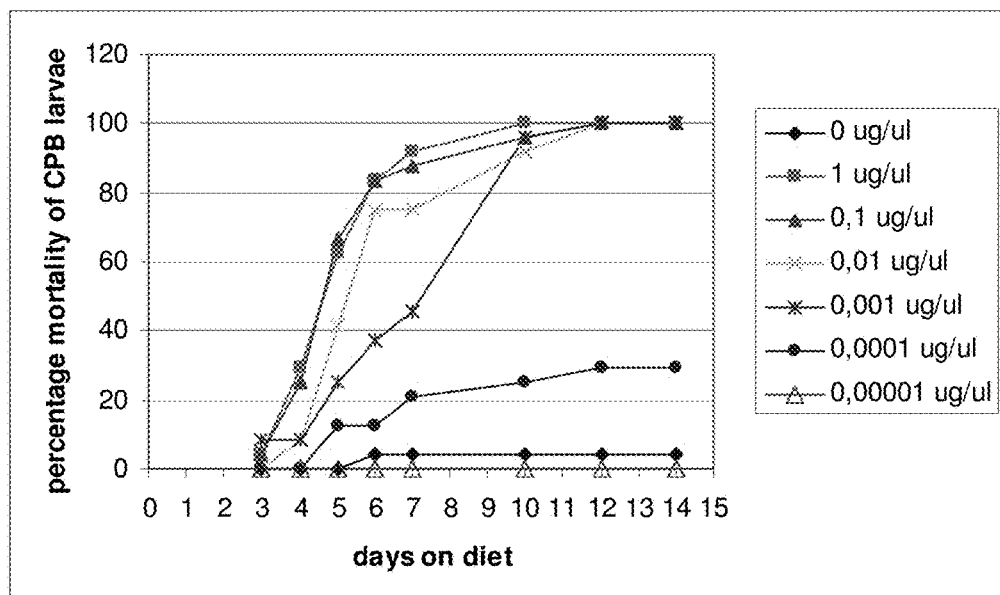
FIGURE 5-LD (c)
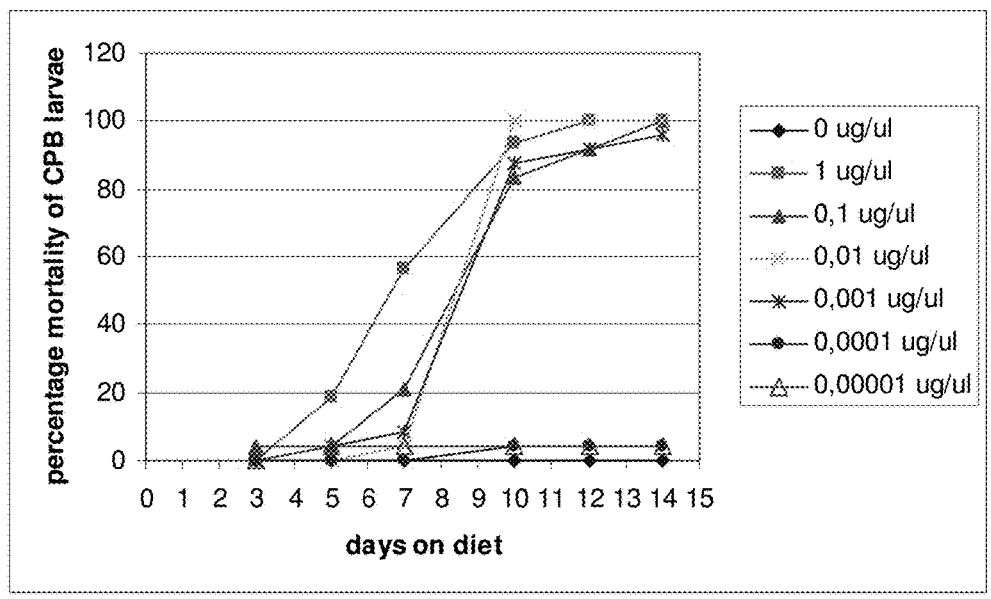
FIGURE 5-LD (d)

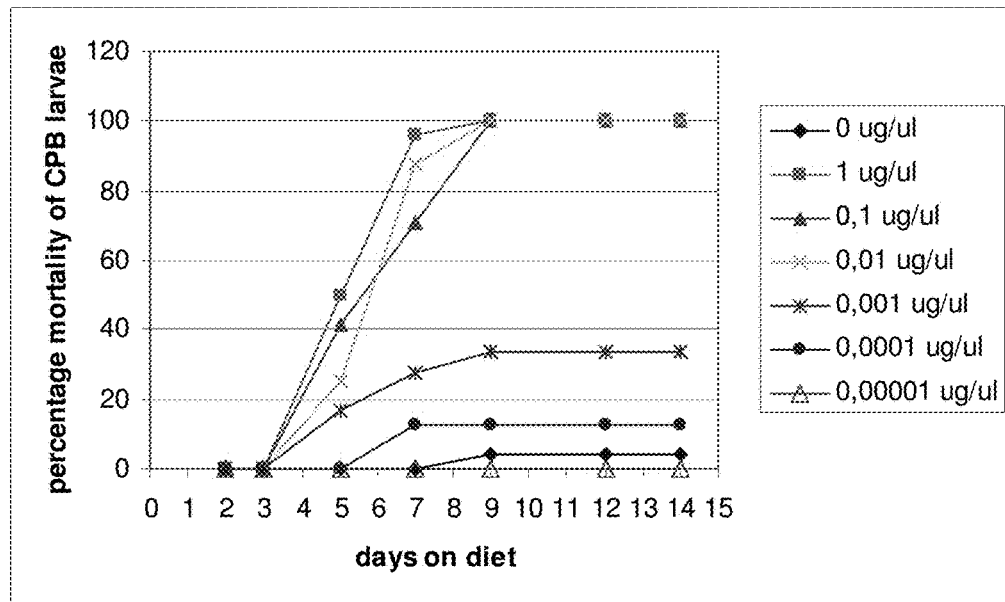
FIGURE 5-LD (e)
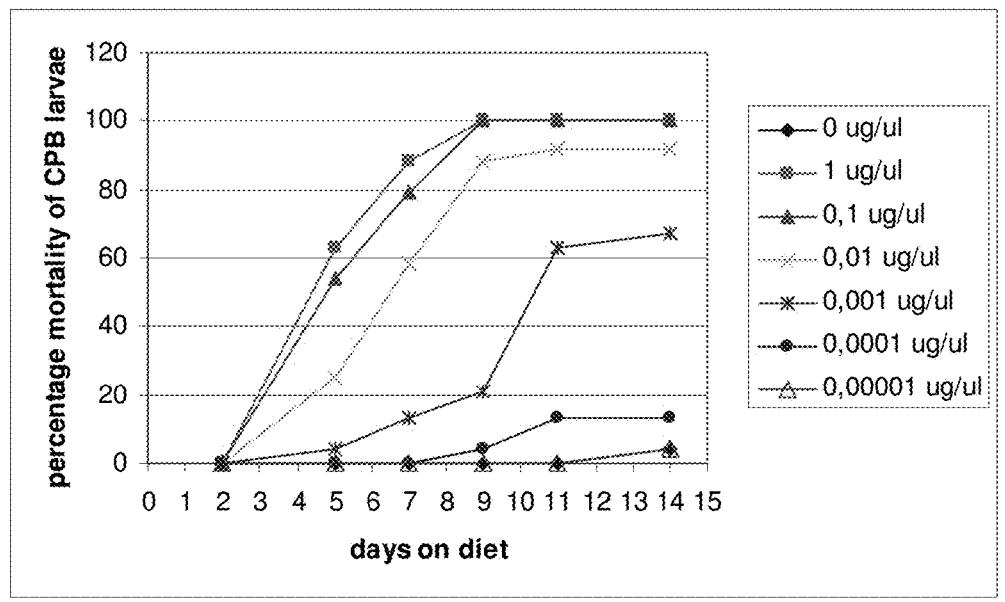
FIGURE 5-LD (f)

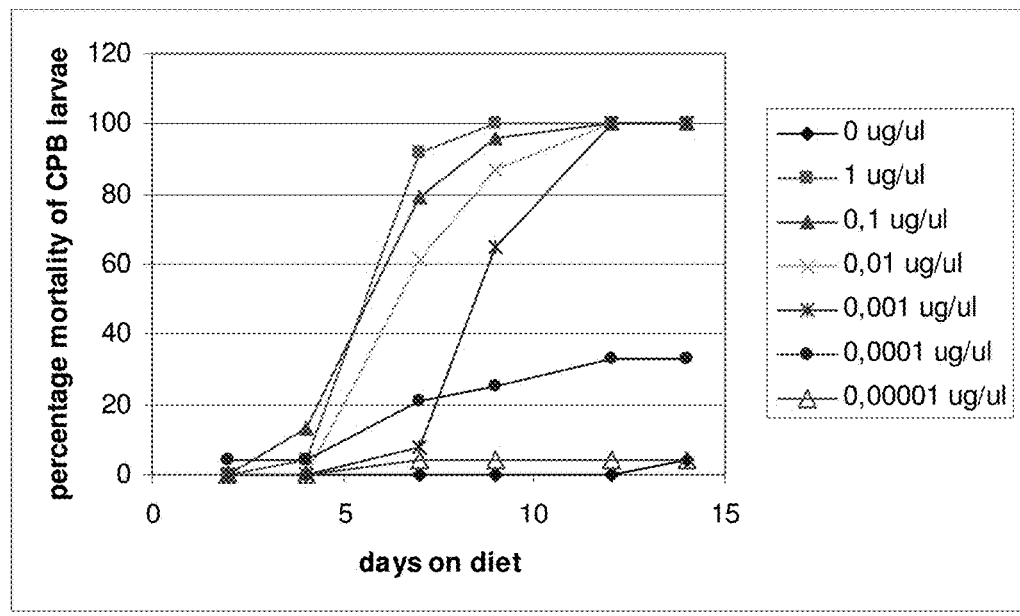
FIGURE 5-LD (g)
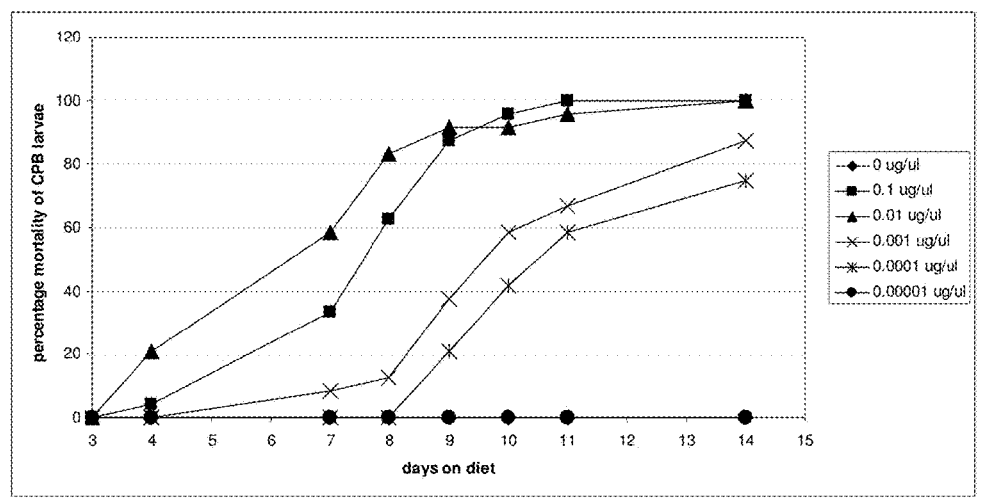
FIGURE 5-LD (h)

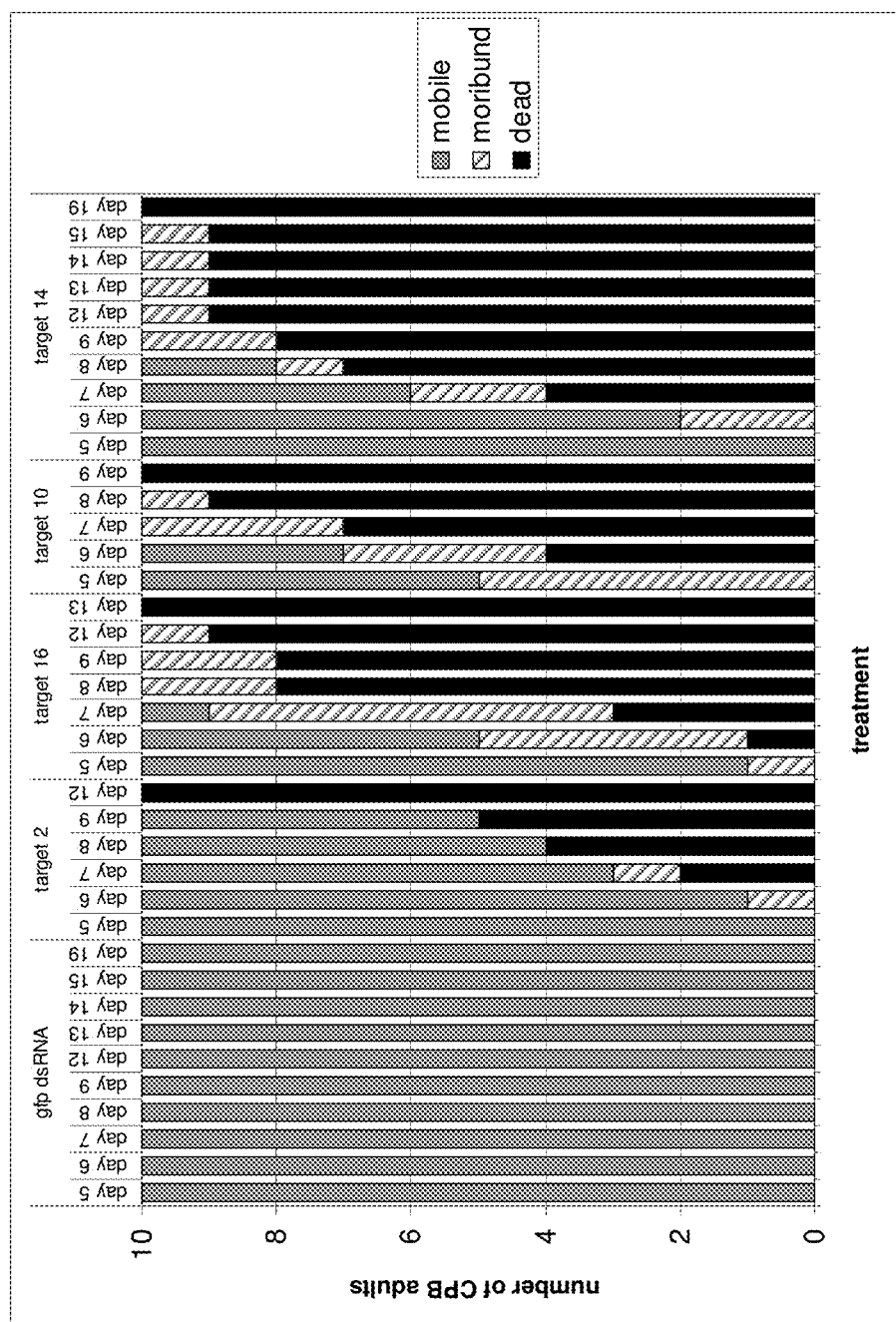
FIGURE 6-LD

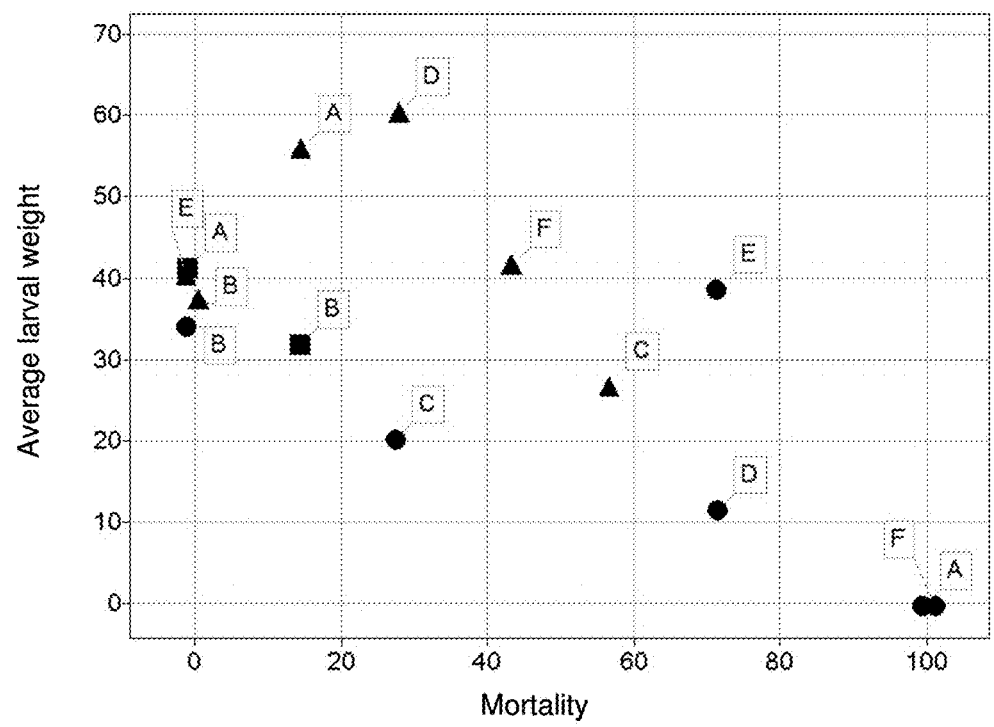
FIGURE 7-LD

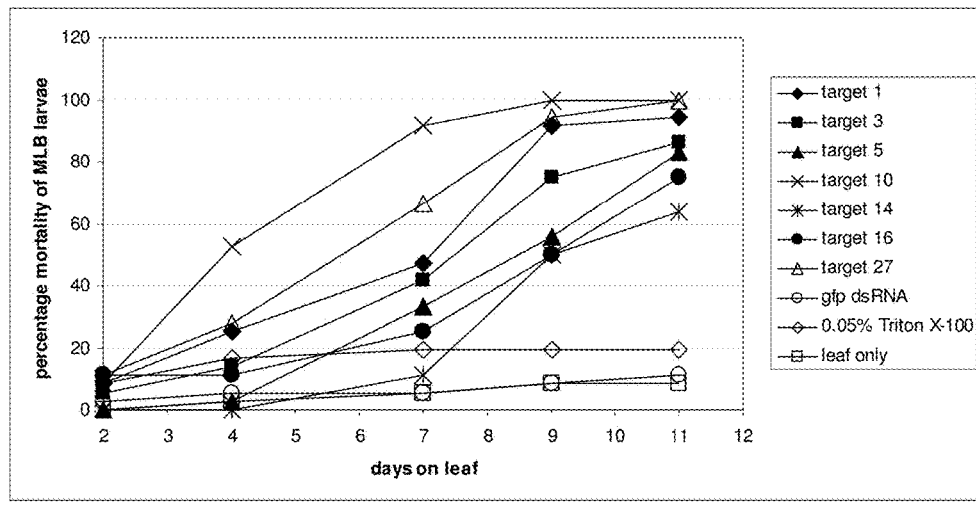
FIGURE 1-PC (a)
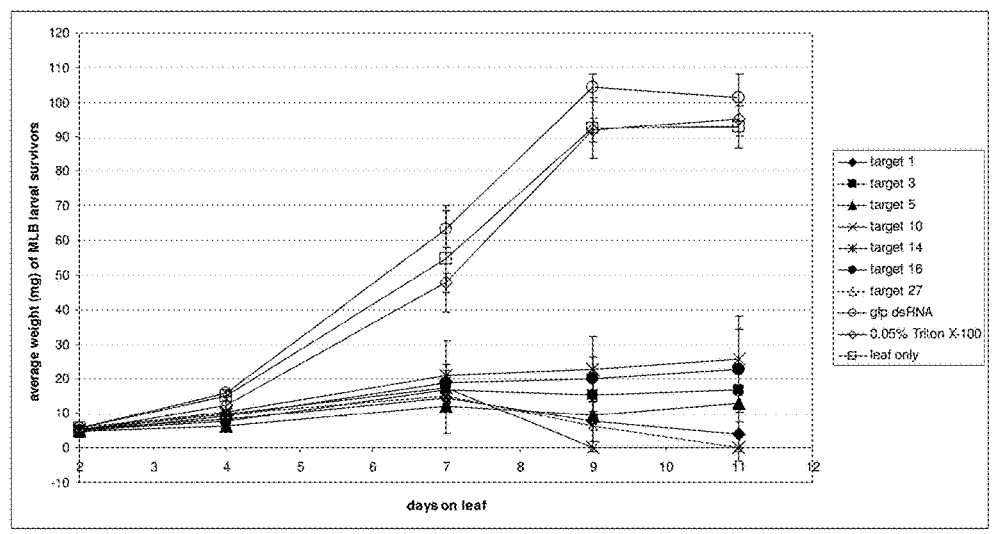
FIGURE 1-PC (b)

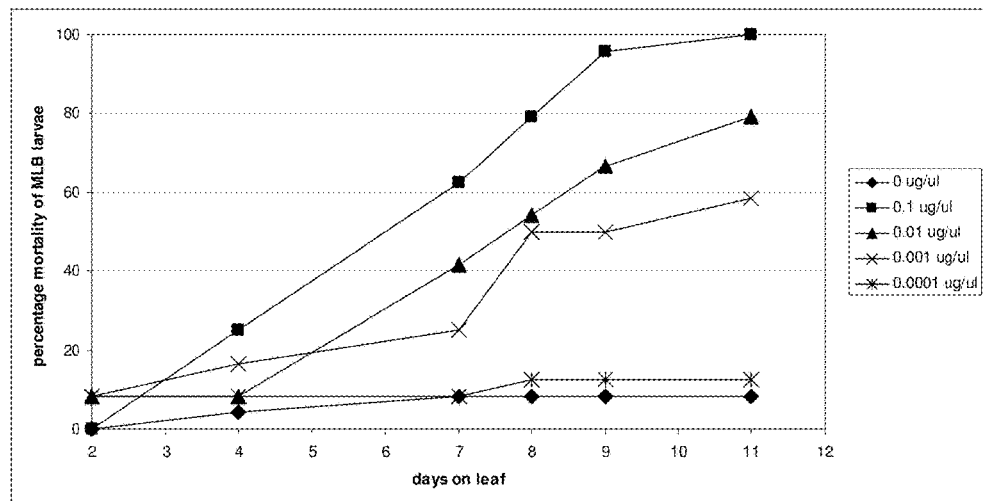
FIGURE 2-PC (a)
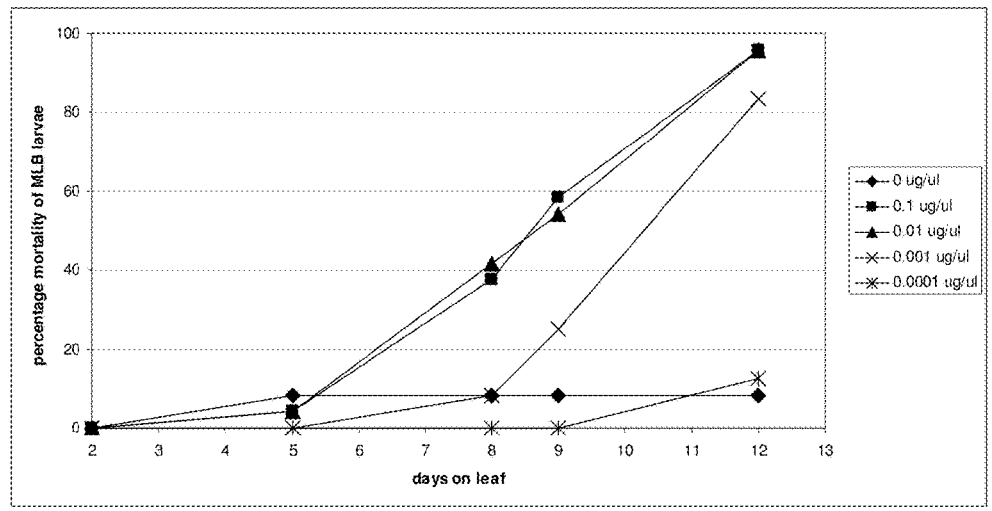
FIGURE 2-PC (b)

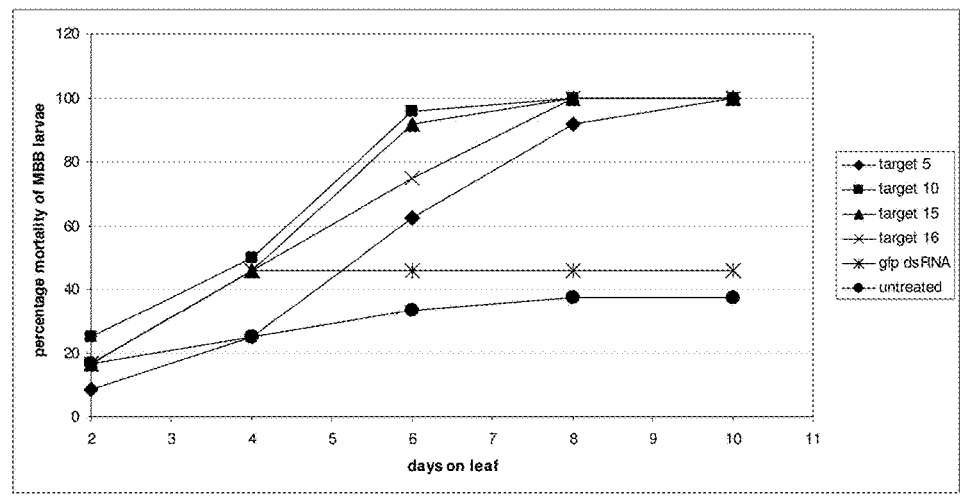
FIGURE 1-EV
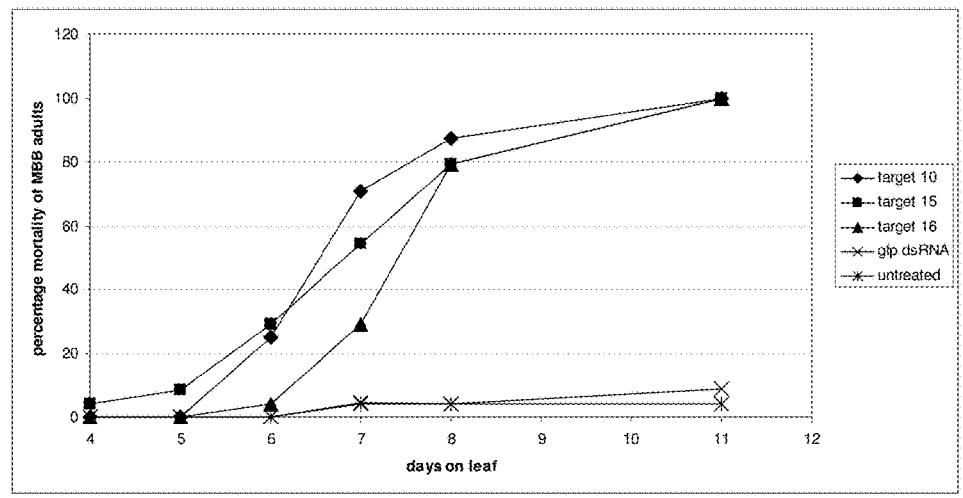
FIGURE 2-EV (a)

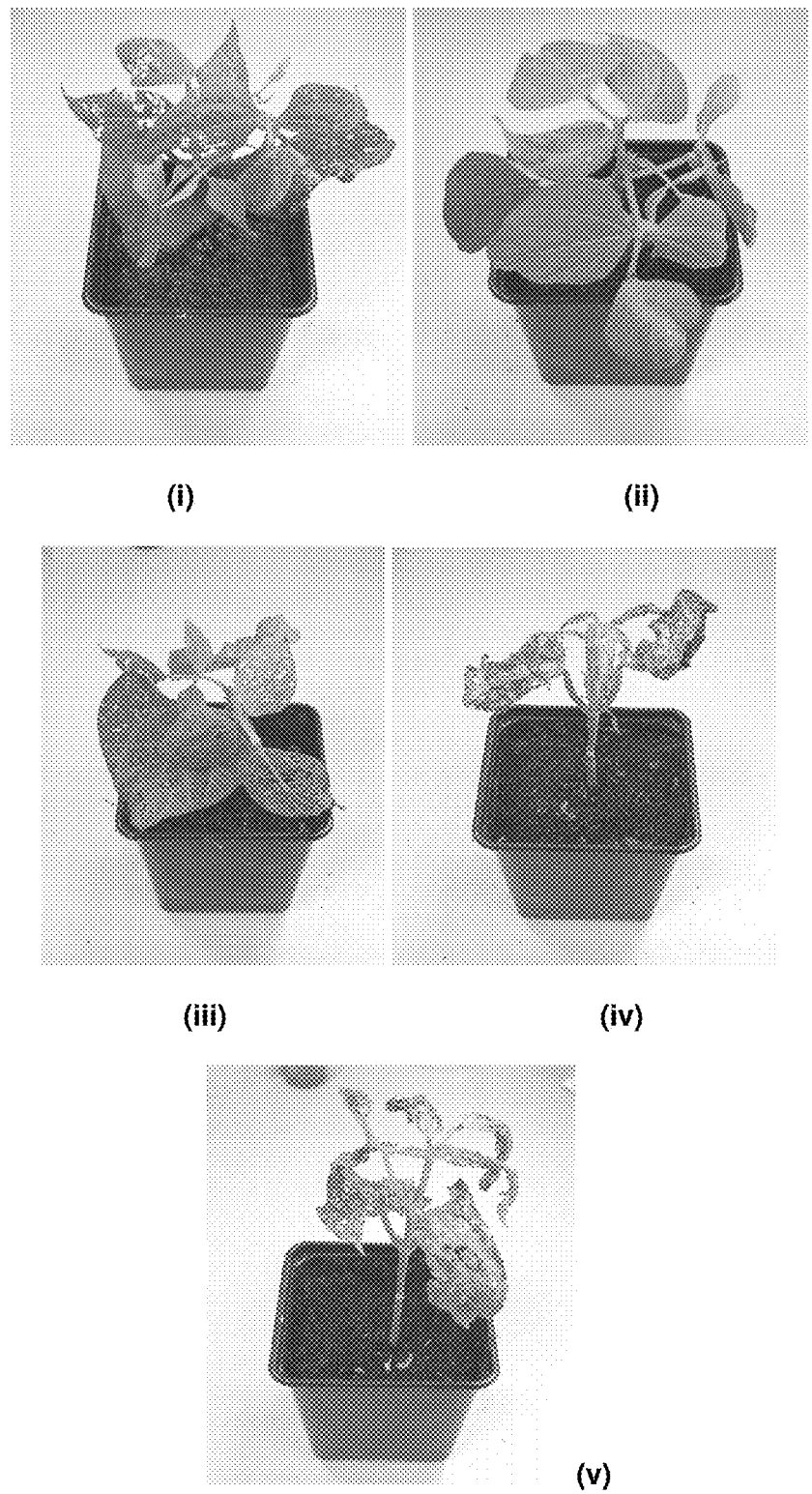
FIGURE 2-EV (b)

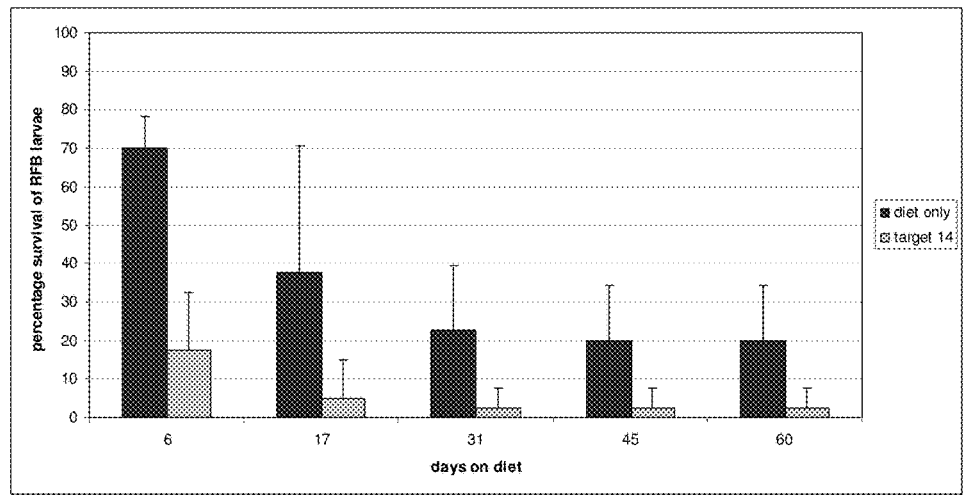
FIGURE 1-TC
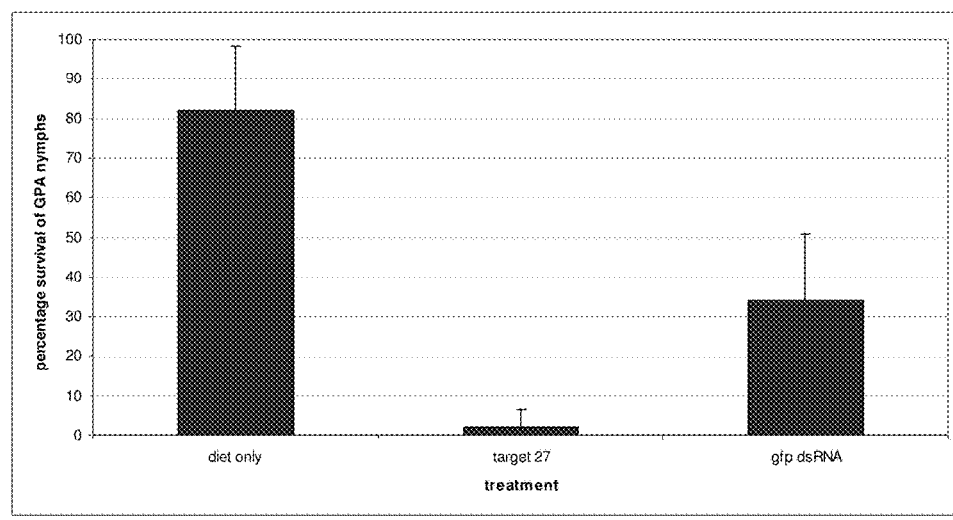
FIGURE 1-MP

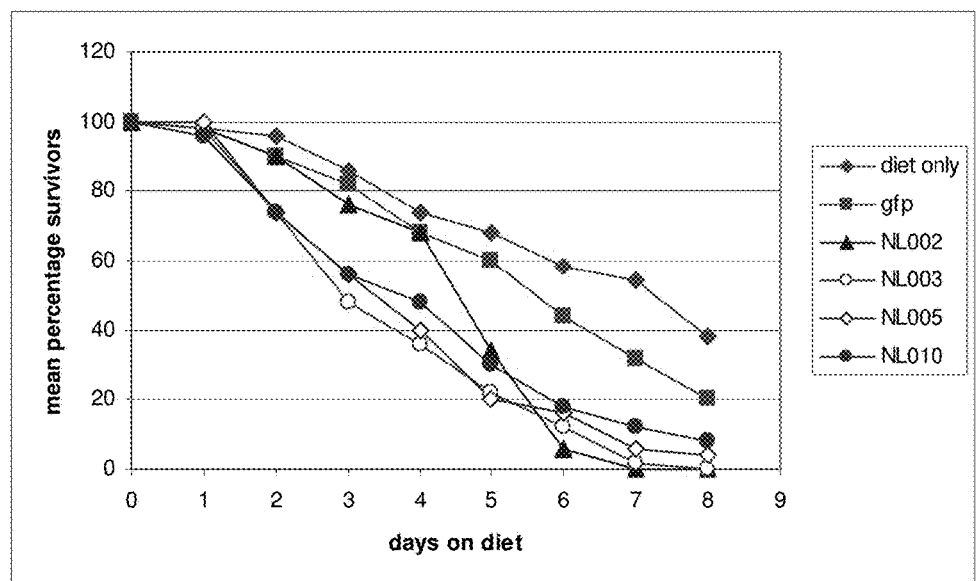
FIGURE 1-NL (a)
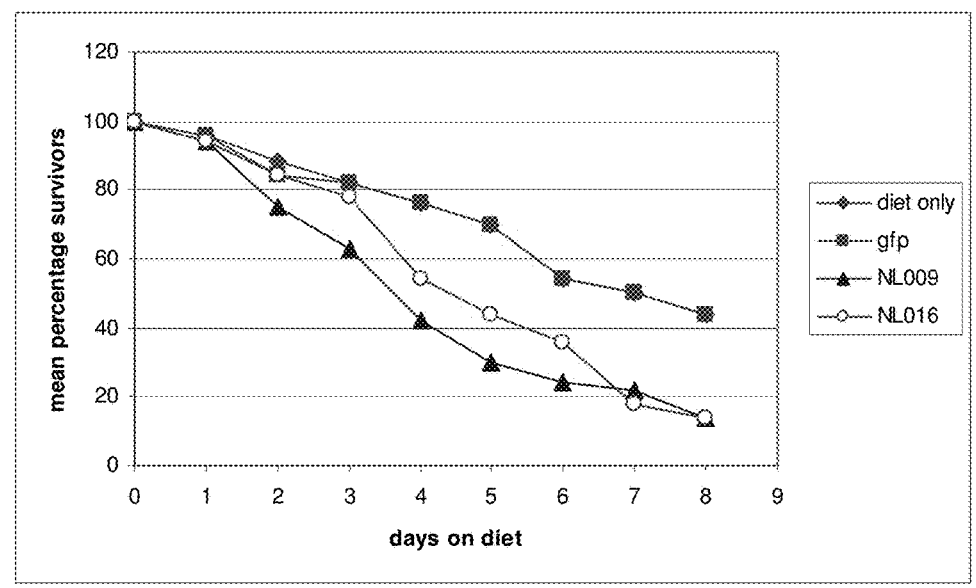
FIGURE 1-NL (b)

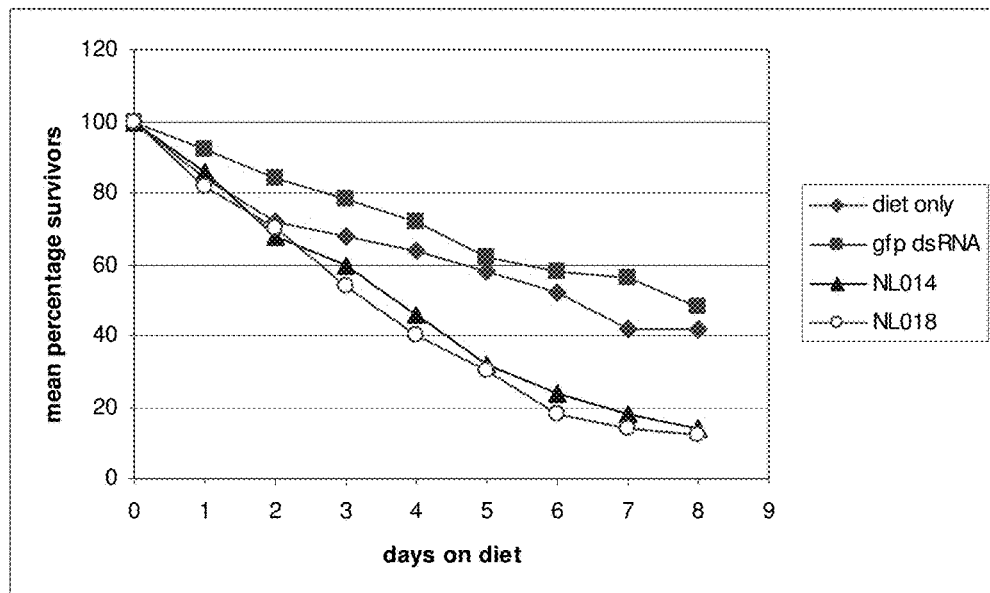
FIGURE 1-NL (c)
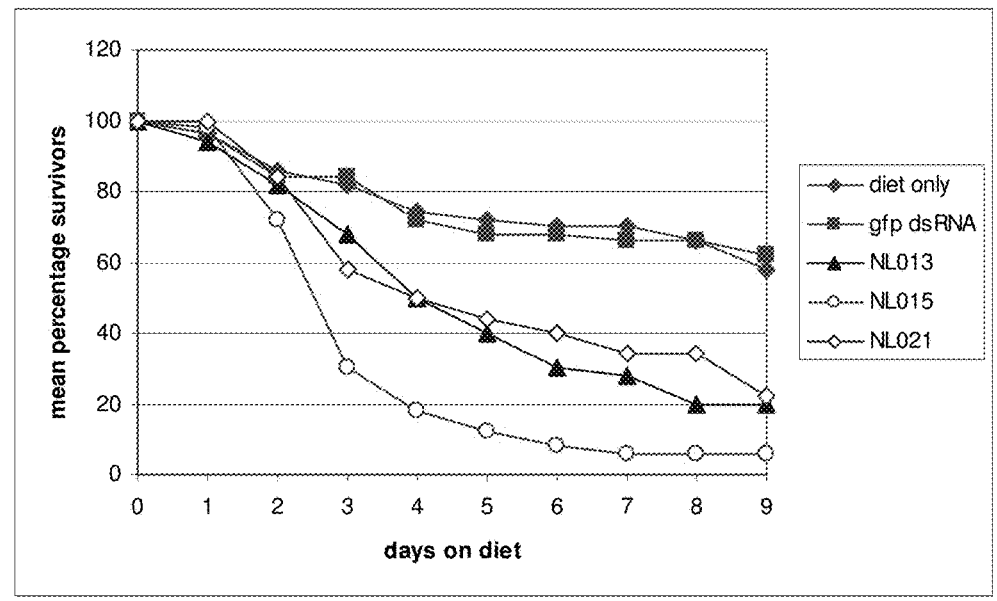
FIGURE 1-NL (d)

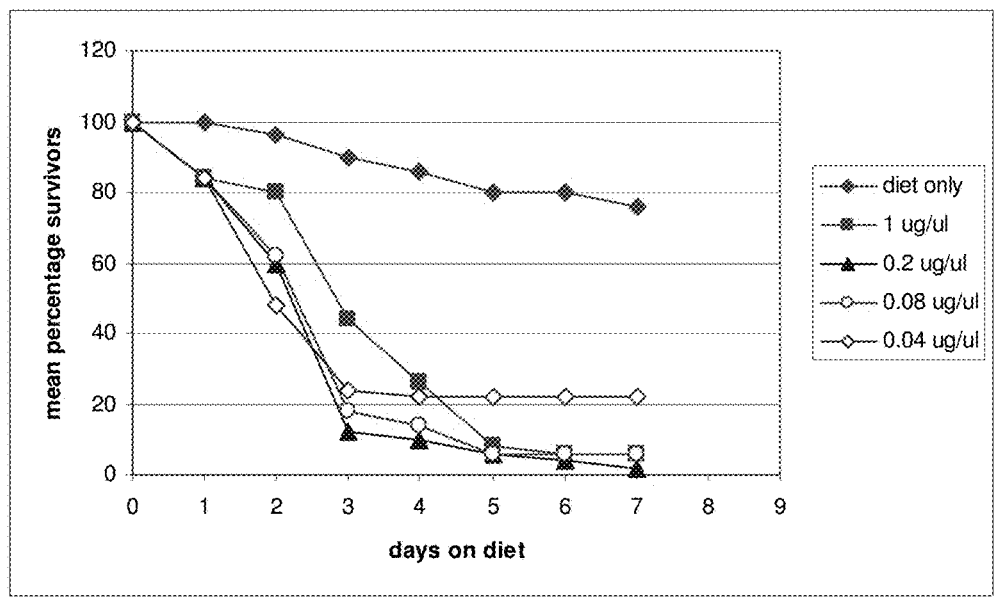
FIGURE 2-NL

DSRNA AS INSECT CONTROL AGENT

CROSS REFERENCE TO RELATED APPLICATIONS

This application is a divisional application of, and claims priority to U.S. patent application Ser. No. 12/087,536 filed on Jan. 13, 2009 which is a national stage filing under 35 U.S.C. §371 of International Application No. PCT/EP2007/000286, filed on Jan. 12, 2007, which claims benefit of 60/758,191, filed on Jan. 12, 2006, and claims benefit of 60/771,160, filed on Feb. 7, 2006, and claims benefit of 60/837,910, filed on Aug. 16, 2006, and claims benefit of 60/875,356, filed on Dec. 18, 2006, the contents of each of which are herein incorporated by reference in their entireties.

SEQUENCE LISTING

A Sequence Listing in ASCII text format, submitted under 37 CFR §1.821, entitled "80388.txt", 736 kilobytes in size, generated on Aug. 26, 2014 and filed via EFS-Web is provided in lieu of a paper copy. This sequence listing is hereby incorporated by reference into the specification for its disclosures.

FIELD OF THE INVENTION

The present invention relates to the field of double-stranded RNA (dsRNA)-mediated gene silencing in insect species. More particularly, the present invention relates to genetic constructs designed for the expression of dsRNA corresponding to novel target genes. These constructs are particularly useful in RNAi-mediated plant pest control. The invention further relates to methods for controlling insects, methods for preventing insect infestation and methods for down-regulating gene expression in insects using RNAi. The invention also relates to transgenic plants resistant to insect infestation.

BACKGROUND TO THE INVENTION

The environment is replete with pests and numerous methods have attempted to control pests infestations of plants. Commercial crops are often the targets of insect attack. Substantial progress has been made in the last few decades towards developing more efficient methods and compositions for controlling insect infestation in plants.

Chemical pesticides have been very effective in eradicating pest infestation. However, there are several disadvantages to using chemical pesticidal agents. Not only are they potentially detrimental to the environment, but they are not selective and are harmful to various crops and non-target fauna. Chemical pesticides persist in the environment and generally are slow to be metabolized, if at all. They accumulate in the food chain, and particularly in the higher predator species where they can act as mutagens and/or carcinogens to cause irreversible and deleterious genetic modifications. There has thus been continued controversy in the use of chemical insecticides to combat crop pests. They can rapidly develop resistance against these insecticides because of repetitive usage of the same insecticide or of insecticides having the same mode of action, and because accumulation also results in the development of resistance to the agents in species higher up the evolutionary ladder.

Control of insect pests on agronomically important crops is important, particularly insect pests which damage plants belonging to the Solanaceae family, especially potato (*Solanum tuberosum*), but also tomato (*Solanum lycopersicum*), eggplant (*Solanum melongena*), capsicums (*Solanum capsicum*), and nightshade (for example, *Solanum aculeastrum, S. bulbocastanum, S. cardiophyllum, S. douglasii, S. dulcamara, S. lanceolatum, S. robustum,* and *S. triquetrum*), particularly the control of coleopteran pests.

Biological control using extract from neem seed has been shown to work against coleopteran pests of vegetables. Commercially available neem-based insecticides have azadirachtin as the primary active ingredient. These insecticides are applicable to a broad spectrum of insects. They act as insect growth regulator; azadirachtin prevents insects from molting by inhibiting production of an insect hormone, ecdysone.

Biological control using protein Cry3A from *Bacillus thuringiensis* varieties tenebrionis and san diego, and derived insecticidal proteins are alternatives to chemical control. The Bt toxin protein is effective in controlling Colorado potato beetle larvae either as formulations sprayed onto the foliage or expressed in the leaves of potatoes.

An alternative biological agent is dsRNA. Over the last few years, down-regulation of genes (also referred to as "gene silencing") in multicellular organisms by means of RNA interference or "RNAi" has become a well-established technique.

RNA interference or "RNAi" is a process of sequence-specific down-regulation of gene expression (also referred to as "gene silencing" or "RNA-mediated gene silencing") initiated by double-stranded RNA (dsRNA) that is complementary in sequence to a region of the target gene to be down-regulated (Fire, A. Trends Genet. Vol. 15, 358-363, 1999; Sharp, P. A. Genes Dev. Vol. 15, 485-490, 2001).

Over the last few years, down-regulation of target genes in multicellular organisms by means of RNA interference (RNAi) has become a well established technique. Reference may be made to International Applications WO 99/32619 (Carnegie Institution) and WO 00/01846 (by Applicant).

DsRNA gene silencing finds application in many different areas, such as for example dsRNA mediated gene silencing in clinical applications (WO2004/001013) and in plants. In plants, dsRNA constructs useful for gene silencing have also been designed to be cleaved and to be processed into short interfering RNAs (siRNAs).

RNAi has also been proposed as a means of protecting plants against plant parasitic nematodes, i.e. by expressing in the plant (e.g. in the entire plant, or in a part, tissue or cell of a plant) one or more nucleotide sequences that form a dsRNA fragment that corresponds to a target gene in the plant parasitic nematode that is essential for its growth, reproduction and/or survival. Reference may be made to the International Application WO 00/01846 (by Applicant) and U.S. Pat. No. 6,506,559 (based on WO 99/32619).

Although the technique of RNAi has been generally known in the art in plants, *C. elegans* and mammalian cells for some years, to date little is known about the use of RNAi to down-regulate gene expression in insects. Since the filing and publication of the WO 00/01846 and WO 99/32619 applications, only few other applications have been published that relate to the use of RNAi to protect plants against insects. These include the International Applications WO 01/37654 (DNA Plant Technologies), WO 2005/019408 (Bar Ilan University), WO 2005/049841 (CSIRO, Bayer Cropscience), WO 05/047300 (University of Utah Research foundation), and the US application 2003/00150017 (Mesa et al.).

The present invention provides target genes and constructs useful in the RNAi-mediated insect pest control, especially the control of insect plant pathogens. The present invention also provides methods for controlling insect pest infestation by repressing, delaying, or otherwise reducing target gene expression within a particular insect pest.

DESCRIPTION OF THE INVENTION

The present invention describes a novel non-compound, non-protein based approach for the control of insect crop pests. The active ingredient is a nucleic acid, a double-stranded RNA (dsRNA), which can be used as an insecticidal formulation. In another embodiment, the dsRNA can be expressed constitutively in the host plant, plant part, plant cell or seed to protect the plant against chewing insects especially coleopterans such as beetles. The sequence of the dsRNA corresponds to part or whole of an essential insect gene and causes downregulation of the insect target via RNA interference (RNAi). As a result of the downregulation of mRNA, the dsRNA prevents expression of the target insect protein and hence causes death, growth arrest or sterility of the insect.

The methods of the invention can find practical application in any area of technology where it is desirable to inhibit viability, growth, development or reproduction of the insect, or to decrease pathogenicity or infectivity of the insect. The methods of the invention further find practical application where it is desirable to specifically down-regulate expression of one or more target genes in an insect. Particularly useful practical applications include, but are not limited to, protecting plants against insect pest infestation.

In accordance with one embodiment the invention relates to a method for controlling insect growth on a cell or an organism, or for preventing insect infestation of a cell or an organism susceptible to insect infection, comprising contacting insects with a double-stranded RNA, wherein the double-stranded RNA comprises annealed complementary strands, one of which has a nucleotide sequence which is complementary to at least part of the nucleotide sequence of an insect target gene, whereby the double-stranded RNA is taken up by the insect and thereby controls growth or prevents infestation.

The present invention therefore provides isolated novel nucleotide sequences of insect target genes, said isolated nucleotide sequences comprising at least one nucleic acid sequence selected from the group comprising:

(i) sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or the complement thereof, (ii) sequences which are at least 70%, preferably at least 75%, 80%, 85%, 90%, more preferably at least 95%, 96%, 97%, 98% or 99% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or the complement thereof, and (iii) sequences comprising at least 17 contiguous nucleotides of any of the sequences represented by SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or the complement thereof, or wherein said nucleic acid sequence is an orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or a complement thereof, said nucleic acid sequences being useful for preparing the double stranded RNAs of the invention for controlling insect growth.

"Controlling pests" as used in the present invention means killing pests, or preventing pests to develop, or to grow or preventing pests to infect or infest. Controlling pests as used herein also encompasses controlling pest progeny (development of eggs). Controlling pests as used herein also encompasses inhibiting viability, growth, development or reproduction of the pest, or to decrease pathogenicity or infectivity of the pest. The compounds and/or compositions described herein, may be used to keep an organism healthy and may be used curatively, preventively or systematically to control pests or to avoid pest growth or development or infection or infestation. Particular pests envisaged in the present invention are plant pathogenic insect pests. "Controlling insects" as used herein thus also encompasses controlling insect progeny (such as development of eggs). Controlling insects as used herein also encompasses inhibiting viability, growth, development or reproduction of the insect, or decreasing pathogenicity or infectivity of the insect. In the present invention, controlling insects may inhibit a biological activity in a insect, resulting in one or more of the following attributes: reduction in feeding by the insect, reduction in viability of the insect, death of the insect, inhibition of differentiation and development of the insect, absence of or reduced capacity for sexual reproduction by the insect, muscle formation, juvenile hormone formation, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, apoptosis, and any component of a eukaryotic cells' cytoskeletal structure, such as, for example, actins and tubulins. The compounds and/or compositions described herein, may be used to keep an organism healthy and may be used curatively, preventively or systematically to control a insect or to avoid insect growth or development or infection or infestation. Thus, the invention may allow previously susceptible organisms to develop resistance against infestation by the insect organism.

The expression "complementary to at least part of" as used herein means that the nucleotide sequence is fully complementary to the nucleotide sequence of the target over more than two nucleotides, for instance over at least 15, 16, 17, 18, 19, 20, 21, 22, 23, 24 or more contiguous nucleotides.

According to a further embodiment, the invention relates to a method for down-regulating expression of a target gene in an insect, comprising contacting said insect with a double-stranded RNA, wherein the double-stranded RNA comprises annealed complementary strands, one of which has a nucleotide sequence which is complementary to at least part of the nucleotide sequence of the insect target gene to be down-regulated, whereby the double-stranded RNA is taken up into the insect and thereby down-regulates expression of the insect target gene.

Whenever the term "a" is used within the context of "a target gene", this means "at least one" target gene. The same applies for "a" target organism meaning "at least one" target organism, and "a" RNA molecule or host cell meaning "at least one" RNA molecule or host cell. This is also detailed further below.

According to one embodiment, the methods of the invention rely on uptake by the insect of double-stranded RNA present outside of the insect (e. g. by feeding) and does not require expression of double-stranded RNA within cells of the insect. In addition, the present invention also encompasses methods as described above wherein the insect is contacted with a composition comprising the double-stranded RNA.

The invention further provides a method for down-regulating expression of at least one target gene in a target organism (which is capable of ingesting a plant, plant part, plant cell or seeds) comprising feeding a plant, plant part, plant cell or seed to the target organism which plant, plant part, plant cell or seed expresses double-stranded RNA.

In a more preferred aspect, the invention provides a method for down-regulating expression of at least one target gene in a target organism (which is capable of ingesting a host cell, or extracts thereof) comprising feeding a hostplant, plant part, plant cell or seed to the target organism which hostplant, plant part, plant cell or seed expresses a double-stranded RNA molecule comprising a nucleotide sequence complementary to or representing the RNA equivalent of at least part of the nucleotide sequence of the at least one target gene, whereby the ingestion of the host cell, host plant, plant part, plant cell or seed by the target organism causes and/or leads to down-regulation of expression of the at least one target gene.

The invention provides for use of a plant, plant part, plant cell or seed as defined herein for down regulation of expression of an insect target gene. In more detailed terms, the invention provides for use of a host cell as defined herein and/or an RNA molecule comprising a nucleotide sequence that is the RNA complement of or that represents the RNA equivalent of at least part of the nucleotide sequence of a target gene from a target organism, as produced by transcription of a nucleic acid molecule in a plant, plant part, plant cell or seed, for instance in the manufacture of a commodity product, for down regulation of expression of a target gene. Suitable target genes and target organisms in respect of the invention are discussed below in further detail.

According to one embodiment, the methods of the invention rely on a GMO approach wherein the double-stranded RNA is expressed by a cell or an organism infested with or susceptible to infestation by insects. Preferably, said cell is a plant cell or said organism is a plant.

The present invention thus also relates to a method for producing a plant resistant to a plant pathogenic insect, comprising:

transforming a plant cell with a recombinant construct comprising at least one regulatory sequence operably linked to a sequence complementary to at least part of
(a) a nucleotide sequence of a target insect gene selected from the group consisting of:
(i) sequences which are at least 75% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof,
(ii) sequences comprising at least 17 contiguous nucleotides of any of SEQ ID Nos 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, and (iii) sequences comprising a sense strand comprising a nucleotide sequence of (i) and an antisense strand comprising the complement of said nucleotide sequence of (i), wherein the transcript encoded by said nucleotide sequence is capable of forming a double-stranded RNA, or (b) a nucleotide sequence which is an insect orthologue of a gene comprising at least 17 contiguous nucleotides of any of SEQ ID Nos 49 to 158, 275 to 472, 533 to 575, 621 to 767, 813 to 862, 908 to 1040, 1161 to 1571, 1730 to 2039, 2120 to 2338, 2384 to 2460, or the complement thereof;

regenerating a plant from the transformed plant cell; and growing the transformed plant under conditions suitable for the expression of the recombinant construct, said grown transformed plant resistant to plant pathogenic insects compared to an untransformed plant.

The insect can be any insect, meaning any organism belonging to the Kingdom Animals, more specific to the Phylum Arthropoda, and to the Class Insecta or the Class Arachnida. The methods of the invention are applicable to all insects and that are susceptible to gene silencing by RNA interference and that are capable of internalising double-stranded RNA from their immediate environment. The invention is also applicable to the insect at any stage in its development. Because insects have a non-living exoskeleton, they cannot grow at a uniform rate and rather grow in stages by periodically shedding their exoskeleton. This process is referred to as moulting or ecdysis. The stages between moults are referred to as "instars" and these stages may be targeted according to the invention. Also, insect eggs or live young may also be targeted according to the present invention. All stages in the developmental cycle, which includes metamorphosis in the pterygotes, may be targeted according to the present invention. Thus, individual stages such as larvae, pupae, nymph etc stages of development may all be targeted.

In one embodiment of the invention, the insect may belong to the following orders: Acari, Araneae, Anoplura, Coleoptera, Collembola, Dermaptera, Dictyoptera, Diplura, Diptera, Embioptera, Ephemeroptera, Grylloblatodea, Hemiptera, Homoptera, Hymenoptera, Isoptera, Lepidoptera, Mallophaga, Mecoptera, Neuroptera, Odonata, Orthoptera, Phasmida, Plecoptera, Protura, Psocoptera, Siphonaptera, Siphunculata, Thysanura, Strepsiptera, Thysanoptera, Trichoptera, and Zoraptera.

In preferred, but non-limiting, embodiments and methods of the invention the insect is chosen from the group consisting of an insect which is a plant pest, such as but not limited to *Nilaparvata* spp. (e.g. *N. lugens* (brown planthopper)); *Laodelphax* spp. (e.g. *L. striatellus* (small brown planthopper)); *Nephotettix* spp. (e.g. *N. virescens* or *N. cincticeps* (green leafhopper), or *N. nigropictus* (rice leafhopper)); *Sogatella* spp. (e.g. *S. furcifera* (white-backed planthopper)); *Blissus* spp. (e.g. *B. leucopterus leucopterus* (chinch bug)); *Scotinophora* spp. (e.g. *S. vermidulate* (rice blackbug)); *Acrosternum* spp. (e.g. *A. hilare* (green stink bug)); *Parnara* spp. (e.g. *P. guttata* (rice skipper)); *Chilo* spp. (e.g. *C. suppressalis* (rice striped stem borer), *C. auricilius* (gold-fringed stem borer), or *C. polychlysus* (dark-headed stem borer)); *Chilotraea* spp. (e.g. *C. polychrysa* (rice stalk borer)); *Sesamia* spp. (e.g. *S. inferens* (pink rice borer)); *Tryporyza* spp. (e.g. *T. innotata* (white rice borer), or *T. incertulas* (yellow rice borer)); *Cnaphalocrocis* spp. (e.g. *C. medinalis* (rice leafroller)); *Agromyza* spp. (e.g. *A. oryzae* (leafminer), or *A. parvicornis* (corn blot leafminer)); *Diatraea* spp. (e.g. *D. saccharalis* (sugarcane borer), or *D. grandiosella* (southwestern corn borer)); *Narnaga* spp. (e.g. *N. aenescens* (green rice caterpillar)); *Xanthodes* spp. (e.g. *X. transverse* (green caterpillar)); *Spodoptera* spp. (e.g. *S. frugiperda* (fall armyworm), *S. exigua* (beet armyworm), *S. littoralis* (climbing cutworm) or *S. praefica* (western yellowstriped armyworm)); *Mythimna* spp. (e.g. *Mythmna (Pseudaletia) seperata* (armyworm)); *Helicoverpa* spp. (e.g. *H. zea* (corn earworm)); *Colaspis* spp. (e.g. *C. brunnea* (grape colaspis)); *Lissorhoptrus* spp. (e.g. *L. oryzophilus* (rice water weevil)); *Echinocnemus* spp. (e.g. *E. squamos* (rice plant weevil)); *Diclodispa* spp. (e.g. *D. armigera* (rice hispa)); *Oulema* spp. (e.g. *O. oryzae* (leaf beetle); *Sitophilus* spp. (e.g. *S. oryzae* (rice weevil)); *Pachydiplosis* spp. (e.g. *P. oryzae* (rice gall midge)); *Hydrellia* spp. (e.g. *H. griseola* (small rice leafminer), or *H. sasakii* (rice stem maggot)); *Chlorops* spp. (e.g. *C. oryzae* (stem maggot)); *Diabrotica* spp. (e.g. *D. virgifera virgifera* (western corn rootworm), *D. barberi* (northern corn rootworm), *D. undecimpunctata howardi* (southern corn rootworm), *D. virgifera zeae* (Mexican corn rootworm); *D. balteata* (banded cucumber beetle)); *Ostrinia* spp. (e.g. *O. nubilalis* (European corn borer)); *Agrotis* spp. (e.g. *A. ipsilon* (black cutworm)); *Elasmopalpus* spp. (e.g. *E. lignosellus* (lesser cornstalk borer)); *Melanotus* spp. (wireworms); *Cyclocephala* spp. (e.g. *C. borealis* (northern masked chafer), or *C. immaculate* (southern masked chafer)); *Popillia* spp. (e.g. *P. japonica* (Japanese beetle)); *Chaetocnema* spp. (e.g. *C. pulicaria* (corn flea beetle)); *Sphenophorus* spp. (e.g. *S. maidis* (maize billbug)); *Rhopalosiphum* spp. (e.g. *R. maidis* (corn leaf aphid)); *Anuraphis* spp. (e.g. *A. maidiradicis* (corn root aphid)); *Melanoplus* spp. (e.g. *M. femurrubrum* (redlegged grasshopper) *M. differentialis* (differential grasshopper) or *M. sanguinipes* (migratory grasshopper)); *Hylemya* spp. (e.g. *H. platura* (seedcorn maggot)); *Anaphothrips* spp. (e.g. *A. obscrurus* (grass thrips)); *Solenopsis* spp. (e.g. *S. milesta* (thief ant)); or spp. (e.g. *T. urticae* (twospotted spider mite), *T. cinnabarinus* (carmine spider mite); *Helicoverpa* spp. (e.g. *H. zea* (cotton bollworm), or *H. armigera* (American bollworm)); *Pectinophora* spp. (e.g. *P. gossypiella* (pink bollworm)); *Earias* spp. (e.g. *E. vittella* (spotted bollworm)); *Heliothis* spp. (e.g. *H. virescens* (tobacco budworm)); *Anthonomus* spp. (e.g. *A. grandis* (boll weevil)); *Pseudatomoscelis* spp. (e.g. *P. seriatus* (cotton fleahopper)); *Trialeurodes* spp. (e.g. *T. abutiloneus* (banded-winged whitefly) *T. vaporariorum* (greenhouse whitefly)); *Bemisia* spp. (e.g. *B. argentifolii* (silverleaf whitefly)); *Aphis* spp. (e.g. *A. gossypii*

(cotton aphid)); *Lygus* spp. (e.g. *L. lineolaris* (tarnished plant bug) or *L. hesperus* (western tarnished plant bug)); *Euschistus* spp. (e.g. *E. conspersus* (consperse stink bug)); *Chlorochroa* spp. (e.g. *C. sayi* (Say stinkbug)); *Nezara* spp. (e.g. *N. viridula* (southern green stinkbug)); *Thrips* spp. (e.g. *T. tabaci* (onion thrips)); *Frankliniella* spp. (e.g. *F. fusca* (tobacco thrips), or *F. occidentalis* (western flower thrips)); *Leptinotarsa* spp. (e.g. *L. decemlineata* (Colorado potato beetle), *L. juncta* (false potato beetle), or *L. texana* (Texan false potato beetle)); *Lema* spp. (e.g. *L. trilineata* (three-lined potato beetle)); *Epitrix* spp. (e.g. *E. cucumeris* (potato flea beetle), *E. hirtipennis* (flea beetle), or *E. tuberis* (tuber flea beetle)); *Epicauta* spp. (e.g. *E. vittata* (striped blister beetle)); *Phaedon* spp. (e.g. *P. cochleariae* (mustard leaf beetle)); *Epilachna* spp. (e.g. *E. varivetis* (mexican bean beetle)); *Acheta* spp. (e.g. *A. domesticus* (house cricket)); *Empoasca* spp. (e.g. *E. fabae* (potato leafhopper)); *Myzus* spp. (e.g. *M. persicae* (green peach aphid)); *Paratrioza* spp. (e.g. *P. cockerelli* (psyllid)); *Conoderus* spp. (e.g. *C. falli* (southern potato wireworm), or *C. vespertinus* (tobacco wireworm)); *Phthorimaea* spp. (e.g. *P. operculella* (potato tuberworm)); *Macrosiphum* spp. (e.g. *M. euphorbiae* (potato aphid)); *Thyanta* spp. (e.g. *T. pallidovirens* (redshouldered stinkbug)); *Phthorimaea* spp. (e.g. *P. operculella* (potato tuberworm)); *Helicoverpa* spp. (e.g. *H. zea* (tomato fruit-worm); *Keiferia* spp. (e.g. *K. lycopersicella* (tomato pin-worm)); *Limonius* spp. (wireworms); *Manduca* spp. (e.g. *M. sexta* (tobacco hornworm), or *M. quinquemaculata* (tomato hornworm)); *Liriomyza* spp. (e.g. *L. sativae, L. trifolli* or *L. huidobrensis* (leafminer)); *Drosophila* spp. (e.g. *D. melanogaster, D. yakuba, D. pseudoobscura* or *D. simulans*); *Carabus* spp. (e.g. *C. granulatus*); *Chironomus* spp. (e.g. *C. tentanus*); *Ctenocephalides* spp. (e.g. *C. felis* (cat flea)); *Diaprepes* spp. (e.g. *D. abbreviatus* (root weevil)); *Ips* spp. (e.g. *I. pini* (pine engraver)); *Tribolium* spp. (e.g. *T. castaneum* (red floor beetle)); *Glossina* spp. (e.g. *G. morsitans* (tsetse fly)); *Anopheles* spp. (e.g. *A. gambiae* (malaria mosquito)); *Helicoverpa* spp. (e.g. *H. armigera* (African Bollworm)); *Acyrthosiphon* spp. (e.g. *A. pisum* (pea aphid)); *Apis* spp. (e.g. *A. melifera* (honey bee)); *Homalodisca* spp. (e.g. *H. coagulate* (glassy-winged sharpshooter)); *Aedes* spp. (e.g. *Ae. aegypti* (yellow fever mosquito)); *Bombyx* spp. (e.g. *B. mori* (silkworm)); *Locusta* spp. (e.g. *L. migratoria* (migratory locust)); *Boophilus* spp. (e.g. *B. microplus* (cattle tick)); *Acanthoscurria* spp. (e.g. *A. gomesiana* (red-haired chololate bird eater)); *Diploptera* spp. (e.g. *D. punctata* (pacific beetle cockroach)); *Heliconius* spp. (e.g. *H. erato* (red passion flower butterfly) or *H. melpomene* (postman butterfly)); *Curculio* spp. (e.g. *C. glandium* (acorn weevil)); *Plutella* spp. (e.g. *P. xylostella* (diamondback moth)); *Amblyomma* spp. (e.g. *A. variegatum* (cattle tick)); *Anteraea* spp. (e.g. *A. yamamai* (silkmoth)); and *Armigeres* spp. (e.g. *A. subalbatus*);

Preferred plant pathogenic insects according to the invention are plant pest are selected from the group consisting of *Leptinotarsa* spp. (e.g. *L. decemlineata* (Colorado potato beetle), *L. juncta* (false potato beetle), or *L. texana* (Texan false potato beetle)); *Nilaparvata* spp. (e.g. *N. lugens* (brown planthopper)); *Laodelphax* spp. (e.g. *L. striatellus* (small brown planthopper)); *Nephotettix* spp. (e.g. *N. virescens* or *N. cincticeps* (green leafhopper), or *N. nigropictus* (rice leafhopper)); *Sogatella* spp. (e.g. *S. furcifera* (white-backed planthopper)); *Chilo* spp. (e.g. *C. suppressalis* (rice striped stem borer), *C. auricilius* (gold-fringed stem borer), or *C. polychrysus* (dark-headed stem borer)); *Sesamia* spp. (e.g. *S. inferens* (pink rice borer)); *Tryporyza* spp. (e.g. *T. innotata* (white rice borer), or *T. incertulas* (yellow rice borer)); *Anthonomus* spp. (e.g. *A. grandis* (boll weevil)); *Phaedon* spp. (e.g. *P. cochleariae* (mustard leaf beetle)); *Epilachna* spp. (e.g. *E. varivetis* (mexican bean beetle)); *Tribolium* spp. (e.g. *T. castaneum* (red floor beetle)); *Diabrotica* spp. (e.g. *D. virgifera virgifera* (western corn rootworm), *D. barberi* (northern corn rootworm), *D. undecimpunctata howardi* (southern corn rootworm), *D. virgifera zeae* (Mexican corn rootworm); *Ostrinia* spp. (e.g. *O. nubilalis* (European corn borer)); *Anaphothrips* spp. (e.g. *A. obscurus* (grass thrips)); *Pectinophora* spp. (e.g. *P. gossypiella* (pink bollworm)); *Heliothis* spp. (e.g. *H. virescens* (tobacco budworm)); *Trialeurodes* spp. (e.g. *T. abutiloneus* (banded-winged whitefly) *T. vaporariorum* (greenhouse whitefly)); *Bemisia* spp. (e.g. *B. argentifolii* (silverleaf whitefly)); *Aphis* spp. (e.g. *A. gossypii* (cotton aphid)); *Lygus* spp. (e.g. *L. lineolaris* (tarnished plant bug) or *L. hesperus* (western tarnished plant bug)); *Euschistus* spp. (e.g. *E. conspersus* (consperse stink bug)); *Chlorochroa* spp. (e.g. *C. sayi* (Say stinkbug)); *Nezara* spp. (e.g. *N. viridula* (southern green stinkbug)); *Thrips* spp. (e.g. *T. tabaci* (onion thrips)); *Frankliniella* spp. (e.g. *F. fusca* (tobacco thrips), or *F. occidentalis* (western flower thrips)); *Acheta* spp. (e.g. *A. domesticus* (house cricket)); *Myzus* spp. (e.g. *M. persicae* (green peach aphid)); *Macrosiphum* spp. (e.g. *M. euphorbiae* (potato aphid)); *Blissus* spp. (e.g. *B. leucopterus leucopterus* (chinch bug)); *Acrosternum* spp. (e.g. *A. hilare* (green stink bug)); *Chilotraea* spp. (e.g. *C. polychrysa* (rice stalk borer)); *Lissorhoptrus* spp. (e.g. *L. oryzophilus* (rice water weevil)); *Rhopalosiphum* spp. (e.g. *R. maidis* (corn leaf aphid)); and *Anuraphis* spp. (e.g. *A. maidiradicis* (corn root aphid)).

According to a more specific embodiment, the methods of the invention are applicable for *Leptinotarsa* species. *Leptinotarsa* belong to the family of Chrysomelidae or leaf beetles. Chrysomelid beetles such as Flea Beetles and Corn Rootworms and Curculionids such as Alfalfa Weevils are particularly important pests. Flea Beetles include a large number of small leaf feeding beetles that feed on the leaves of a number of grasses, cereals and herbs. Flea Beetles include a large number of genera (e.g., *Attica, Apphthona, Argopistes, Disonycha, Epitrix, Longitarsus, Prodagricomela, Systena*, and *Phyllotreta*). The Flea Beetle, *Phyllotreta cruciferae*, also known as the Rape Flea Beetle, is a particularly important pest. Corn rootworms include species found in the genus *Diabrotica* (e.g., *D. undecimpunctata undecimpunctata, D. undecimpunctata howardii, D. longicornis, D. virgifera* and *D. balteata*). Corn rootworms cause extensive damage to corn and curcubits. The Western Spotted Cucumber Beetle, *D. undecimpunctata undecimpunctata*, is a pest of curcubits in the western U.S. Alfalfa weevils (also known as clover weevils) belong to the genus, *Hypera* (*H. postica, H. brunneipennis, H. nigrirostris, H. punctata* and *H. meles*), and are considered an important pest of legumes. The Egyptian alfalfa weevil, *H. brunneipennis*, is an important pest of alfalfa in the western U.S.

There are more than 30 *Leptinotarsa* species. The present invention thus encompasses methods for controlling *Leptinotarsa* species, more specific methods for killing insects, or preventing *Leptinotarsa* insects to develop or to grow, or preventing insects to infect or infest. Specific *Leptinotarsa* species to control according to the invention include Colorado Potato Beetle (*Leptinotarsa decemlineata* (Say) and False Potato Beetle (*Leptinotarsa juncta* (Say).

CPB is a (serious) pest on our domestic potato (*Solanum tuberosum*), other cultivated and wild tuber bearing and non-tuber bearing potato species (e.g. *S. demissum, S. phureja* a.o.) and other Solanaceous (nightshades) plant species including:

(a) the crop species tomato (several *Lycopersicon* species), eggplant (*Solanum melongena*), peppers (several *Capsicum* species), tobacco (several *Nicotiana* species including ornamentals) and ground cherry (*Physalis* species);

(b) the weed/herb species, horse nettle (*S. carolinense*), common nightshade (*S. dulcamara*), belladonna (*Atropa* species), thorn apple (*datura* species), henbane (*Hyoscyamus* species) and buffalo burr (*S. rostratum*).

FPB is primarily found on horse nettle, but also occurs on common nightshade, ground cherry, and husk tomato (*Physalis* species).

The term "insect" encompasses insects of all types and at all stages of development, including egg, larval or nymphal, pupal and adult stages.

The present invention extends to methods as described herein, wherein the insect is *Leptinotarsa decemlineata* (Colorado potato beetle) and the plant is potato, eggplant, tomato, pepper, tobacco, ground cherry or rice, corn or cotton.

The present invention extends to methods as described herein, wherein the insect is *Phaedon cochleariae* (mustard leaf beetle) and the plant is mustard, chinese cabbage, turnip greens, collard greens or bok choy.

The present invention extends to methods as described herein, wherein the insect is *Epilachna varivetis* (Mexican bean beetle) and the plants are beans, field beans, garden beans, snap beans, lima beans, mung beans, string beans, black-eyed beans, velvet beans, soybeans, cowpeas, pigeon peas, clover or alfalfa.

The present invention extends to methods as described herein, wherein the insect is *Anthonomus grandis* (cotton boll weevil) and the plant is cotton.

The present invention extends to methods as described herein, wherein the insect is *Tribolium castaneum* (red flour beetle) and the plant is in the form of stored grain products such as flour, cereals, meal, crackers, beans, spices, pasta, cake mix, dried pet food, dried flowers, chocolate, nuts, seeds, and even dried museum specimens.

The present invention extends to methods as described herein, wherein the insect is *Myzus persicae* (green peach aphid) and the plant is a tree such as *Prunus*, particularly peach, apricot and plum; a vegetable crop of the families Solanaceae, Chenopodiaceae, Compositae, Cruciferae, and Cucurbitaceae, including but not limited to, artichoke, asparagus, bean, beets, broccoli, Brussels sprouts, cabbage, carrot, cauliflower, cantaloupe, celery, corn, cucumber, fennel, kale, kohlrabi, turnip, eggplant, lettuce, mustard, okra, parsley, parsnip, pea, pepper, potato, radish, spinach, squash, tomato, turnip, watercress, and watermelon; a field crops such as, but not limited to, tobacco, sugar beet, and sunflower; a flower crop or other ornamental plant.

The present invention extends to methods as described herein, wherein the insect is *Nilaparvata lugens* and the plant is a rice plant.

The present invention extends to methods as described herein, wherein the insect is *Chilo suppressalis* (rice striped stem borer) and the plant is a rice plant, bareley, sorghum, maize, wheat or a grass.

The present invention extends to methods as described herein, wherein the insect is *Plutella xylostella* (Diamondback moth) and the plant is a *Brassica* species such as, but not limited to cabbage, chinese cabbage, Brussels sprouts, kale, rapeseed, broccoli, cauliflower, turnip, mustard or radish.

The present invention extends to methods as described herein, wherein the insect is *Acheta domesticus* (house cricket) and the plant is any plant as described herein or any organic matter.

In terms of "susceptible organisms", which benefit from the present invention, any organism which is susceptible to pest infestation is included. Preferably plants may benefit from the present invention by protection from infestation by plant pest organisms.

In a preferred embodiment the susceptible organism is a plant and the pest is a plant pathogenic insect. In this embodiment the insect is contacted with the RNA molecule by expressing the dsRNA molecule in a plant, plant part, plant cell or plant seed that is infested with or susceptible to infestation with the plant pathogenic pest.

In this context the term "plant" encompasses any plant material that it is desired to treat to prevent or reduce insect growth and/or insect infestation. This includes, inter alia, whole plants, seedlings, propagation or reproductive material such as seeds, cuttings, grafts, explants, etc. and also plant cell and tissue cultures. The plant material should express, or have the capability to express, the RNA molecule comprising at least one nucleotide sequence that is the RNA complement of or that represents the RNA equivalent of at least part of the nucleotide sequence of the sense strand of at least one target gene of the pest organism, such that the RNA molecule is taken up by a pest upon plant-pest interaction, said RNA molecule being capable of inhibiting the target gene or down-regulating expression of the target gene by RNA interference.

The target gene may be any of the target genes herein described, for instance a target gene that is essential for the viability, growth, development or reproduction of the pest. The present invention relates to any gene of interest in the insect (which may be referred to herein as the "target gene") that can be down-regulated.

The terms "down-regulation of gene expression" and "inhibition of gene expression" are used interchangeably and refer to a measurable or observable reduction in gene expression or a complete abolition of detectable gene expression, at the level of protein product and/or mRNA product from the target gene. Preferably the down-regulation does not substantially directly inhibit the expression of other genes of the insect. The down-regulation effect of the dsRNA on gene expression may be calculated as being at least 30%, 40%, 50%, 60%, preferably 70%, 80% or even more preferably 90% or 95% when compared with normal gene expression. Depending on the nature of the target gene, down-regulation or inhibition of gene expression in cells of an insect can be confirmed by phenotypic analysis of the cell or the whole insect or by measurement of mRNA or protein expression using molecular techniques such as RNA solution hybridization, PCR, nuclease protection, Northern hybridization, reverse transcription, gene expression monitoring with a microarray, antibody binding, enzyme-linked immunosorbent assay (ELISA), Western blotting, radioimmunoassay (RIA), other immunoassays, or fluorescence-activated cell analysis (FACS).

The "target gene" may be essentially any gene that is desirable to be inhibited because it interferes with growth or pathogenicity or infectivity of the insect. For instance, if the method of the invention is to be used to prevent insect growth and/or infestation then it is preferred to select a target gene which is essential for viability, growth, development or reproduction of the insect, or any gene that is involved with pathogenicity or infectivity of the insect, such that specific inhibition of the target gene leads to a lethal phenotype or decreases or stops insect infestation.

According to one non-limiting embodiment, the target gene is such that when its expression is down-regulated or inhibited using the method of the invention, the insect is killed, or the reproduction or growth of the insect is stopped or retarded. This type of target genes is considered to be essential for the viability of the insect and is referred to as essential genes. Therefore, the present invention encompasses a method as described herein, wherein the target gene is an essential gene.

According to a further non-limiting embodiment, the target gene is such that when it is down-regulated using the method of the invention, the infestation or infection by the insect, the damage caused by the insect, and/or the ability of the insect to infest or infect host organisms and/or cause such damage, is reduced. The terms "infest" and "infect" or "infestation" and "infection" are generally used interchangeably throughout. This type of target genes is considered to be involved in the pathogenicity or infectivity of the insect. Therefore, the present invention extends to methods as described herein, wherein the target gene is involved in the pathogenicity or infectivity of the insect. The advantage of choosing the latter type of target gene is that the insect is blocked to infect further plants or plant parts and is inhibited to form further generations.

According to one embodiment, target genes are conserved genes or insect-specific genes.

In addition, any suitable double-stranded RNA fragment capable of directing RNAi or RNA-mediated gene silencing or inhibition of an insect target gene may be used in the methods of the invention.

In another embodiment, a gene is selected that is essentially involved in the growth, development, and reproduction of a pest, (such as an insect). Exemplary genes include but are not limited to the structural subunits of ribosomal proteins and a beta-coatamer gene, such as the CHD3 gene. Ribosomal proteins such as S4 (RpS4) and S9 (RpS9) are structural constituents of the ribosome involved in protein biosynthesis and which are components of the cytosolic small ribosomal subunit, the ribosomal proteins such as L9 and L19 are structural constituent of ribosome involved in protein biosynthesis which is localised to the ribosome. The beta coatamer gene in *C. elegans* encodes a protein which is a subunit of a multimeric complex that forms a membrane vesicle coat. Similar sequences have been found in diverse organisms such as *Arabidopsis thaliana*, *Drosophila melanogaster*, and *Saccharomyces cerevisiae*. Related sequences are found in diverse organisms such as *Leptinotarsa decemlineata*, *Phaedon cochleariae*, *Epilachna varivestis*, *Anthonomus grandis*, *Tribolium castaneum*, *Myzus persicae*, *Nilaparvata lugens*, *Chilo suppressalis*, *Plutella xylostella* and *Acheta domesticus*.

Other target genes for use in the present invention may include, for example, those that play important roles in viability, growth, development, reproduction, and infectivity. These target genes include, for example, house keeping genes, transcription factors, and pest specific genes or lethal knockout mutations in *Caenorhabditis* or *Drosophila*. The target genes for use in the present invention may also be those that are from other organisms, e.g., from insects or arachnidae (e.g. *Leptinotarsa* spp., *Phaedon* spp., *Epilachna* spp., *Anthonomus* spp., *Tribolium* spp., *Myzus* spp., *Nilaparvata* spp., *Chilo* spp., *Plutella* spp., or *Acheta* spp.).

Preferred target genes include those specified in Table 1A and orthologous genes from other target organisms, such as from other pest organisms.

In the methods of the present invention, dsRNA is used to inhibit growth or to interfere with the pathogenicity or infectivity of the insect.

The invention thus relates to isolated double-stranded RNA comprising annealed complementary strands, one of which has a nucleotide sequence which is complementary to at least part of a target nucleotide sequence of a target gene of an insect. The target gene may be any of the target genes described herein, or a part thereof that exerts the same function.

According to one embodiment of the present invention, an isolated double-stranded RNA is provided comprising annealed complementary strands, one of which has a nucleotide sequence which is complementary to at least part of a nucleotide sequence of an insect target gene, wherein said target gene comprises a sequence which is selected from the group comprising:

(i) sequences which are at least 75% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, and (ii) sequences comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, or wherein said insect target gene is an insect orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or the complement thereof.

Depending on the assay used to measure gene silencing, the growth inhibition can be quantified as being greater than about 5%, 10%, more preferably about 20%, 25%, 33%, 50%, 60%, 75%, 80%, most preferably about 90%, 95%, or about 99% as compared to a pest organism that has been treated with control dsRNA.

According to another embodiment of the present invention, an isolated double-stranded RNA is provided, wherein at least one of said annealed complementary strands comprises the RNA equivalent of at least one of the nucleotide sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or wherein at least one of said annealed complementary strands comprises the RNA equivalent of a fragment of at least 17 basepairs in length thereof, preferably at least 18, 19, 20 or 21, more preferably at least 22, 23 or 24 basepairs in length thereof.

If the method of the invention is used for specifically controlling growth or infestation of a specific insect in or on a host cell or host organism, it is preferred that the double-stranded RNA does not share any significant homology with any host gene, or at least not with any essential gene of the host. In this context, it is preferred that the double-stranded RNA shows less than 30%, more preferably less that 20%, more preferably less than 10%, and even more preferably less than 5% nucleic acid sequence identity with any gene of the host cell. % sequence identity should be calculated across the full length of the double-stranded RNA region. If genomic sequence data is available for the host organism one may cross-check sequence identity with the double-stranded RNA using standard bioinformatics tools. In one embodiment, there is no sequence identity between the dsRNA and a host sequences over 21 contiguous nucleotides, meaning that in this context, it is preferred that 21 contiguous base pairs of the dsRNA do not occur in the genome of the host organism. In another embodiment, there is less than about 10% or less than about 12.5% sequence identity over 24 contiguous nucleotides of the dsRNA with any nucleotide sequence from a host species.

The double-stranded RNA comprises annealed complementary strands, one of which has a nucleotide sequence which corresponds to a target nucleotide sequence of the target gene to be down-regulated. The other strand of the double-stranded RNA is able to base-pair with the first strand.

The expression "target region" or "target nucleotide sequence" of the target insect gene may be any suitable region or nucleotide sequence of the gene. The target region should comprise at least 17, at least 18 or at least 19 consecutive nucleotides of the target gene, more preferably at least 20 or at least 21 nucleotide and still more preferably at least 22, 23 or 24 nucleotides of the target gene.

It is preferred that (at least part of) the double-stranded RNA will share 100% sequence identity with the target region of the insect target gene. However, it will be appreciated that 100% sequence identity over the whole length of the double stranded region is not essential for functional RNA inhibition. RNA sequences with insertions, deletions, and single point mutations relative to the target sequence have also been found to be effective for RNA inhibition. The terms "corresponding to" or "complementary to" are used herein interchangeable, and when these terms are used to refer to sequence correspondence between the double-stranded RNA and the target region of the target gene, they are to be interpreted accordingly, i.e. as not absolutely requiring 100% sequence identity. However, the % sequence identity between the double-stranded RNA and the target region will generally be at least 80% or 85% identical, preferably at least 90%, 95%, 96%, or more preferably at least 97%, 98% and still more preferably at least 99%. Two nucleic acid strands are "substantially complementary" when at least 85% of their bases pair.

The term "complementary" as used herein relates to both DNA-DNA complementarity as to DNA-RNA complementarity. In analogy herewith, the term "RNA equivalent" substantially means that in the DNA sequence(s), the base "T" may be replaced by the corresponding base "U" normally present in ribonucleic acids.

Although the dsRNA contains a sequence which corresponds to the target region of the target gene it is not absolutely essential for the whole of the dsRNA to correspond to the sequence of the target region. For example, the dsRNA may contain short non-target regions flanking the target-specific sequence, provided that such sequences do not affect performance of the dsRNA in RNA inhibition to a material extent.

The dsRNA may contain one or more substitute bases in order to optimise performance in RNAi. It will be apparent to the skilled reader how to vary each of the bases of the dsRNA in turn and test the activity of the resulting dsRNAs (e.g. in a suitable in vitro test system) in order to optimise the performance of a given dsRNA.

The dsRNA may further contain DNA bases, non-natural bases or non-natural backbone linkages or modifications of the sugar-phosphate backbone, for example to enhance stability during storage or enhance resistance to degradation by nucleases.

It has been previously reported that the formation of short interfering RNAs (siRNAs) of about 21 bp is desirable for effective gene silencing. However, in applications of applicant it has been shown that the minimum length of dsRNA preferably is at least about 80-100 bp in order to be efficiently taken up by certain pest organisms. There are indications that in invertebrates such as the free living nematode *C. elegans* or the plant parasitic nematode *Meloidogyne incognita*, these longer fragments are more effective in gene silencing, possibly due to a more efficient uptake of these long dsRNA by the invertebrate.

It has also recently been suggested that synthetic RNA duplexes consisting of either 27-mer blunt or short hairpin (sh) RNAs with 29 bp stems and 2-nt 3' overhangs are more potent inducers of RNA interference than conventional 21-mer siRNAs. Thus, molecules based upon the targets identified above and being either 27-mer blunt or short hairpin (sh) RNA's with 29-bp stems and 2-nt 3' overhangs are also included within the scope of the invention.

Therefore, in one embodiment, the double-stranded RNA fragment (or region) will itself preferably be at least 17 bp in length, preferably 18 or 19 bp in length, more preferably at least 20 bp, more preferably at least 21 bp, or at least 22 bp, or at least 23 bp, or at least 24 bp, 25 bp, 26 bp or at least 27 bp in length. The expressions "double-stranded RNA fragment" or "double-stranded RNA region" refer to a small entity of the double-stranded RNA corresponding with (part of) the target gene.

Generally, the double stranded RNA is preferably between about 17-1500 bp, even more preferably between about 80-1000 bp and most preferably between about 17-27 bp or between about 80-250 bp; such as double stranded RNA regions of about 17 bp, 18 bp, 19 bp, 20 bp, 21 bp, 22 bp, 23 bp, 24 bp, 25 bp, 27 bp, 50 bp, 80 bp, 100 bp, 150 bp, 200 bp, 250 bp, 300 bp, 350 bp, 400 bp, 450 bp, 500 bp, 550 bp, 600 bp, 650 bp, 700 bp, 900 bp, 100 bp, 1100 bp, 1200 bp, 1300 bp, 1400 bp or 1500 bp.

The upper limit on the length of the double-stranded RNA may be dependent on i) the requirement for the dsRNA to be taken up by the insect and ii) the requirement for the dsRNA to be processed within the cell into fragments that direct RNAi. The chosen length may also be influenced by the method of synthesis of the RNA and the mode of delivery of the RNA to the cell. Preferably the double-stranded RNA to be used in the methods of the invention will be less than 10,000 bp in length, more preferably 1000 bp or less, more preferably 500 bp or less, more preferably 300 bp or less, more preferably 100 bp or less. For any given target gene and insect, the optimum length of the dsRNA for effective inhibition may be determined by experiment.

The double-stranded RNA may be fully or partially double-stranded. Partially double-stranded RNAs may include short single-stranded overhangs at one or both ends of the double-stranded portion, provided that the RNA is still capable of being taken up by insects and directing RNAi. The double-stranded RNA may also contain internal non-complementary regions.

The methods of the invention encompass the simultaneous or sequential provision of two or more different double-stranded RNAs or RNA constructs to the same insect, so as to achieve down-regulation or inhibition of multiple target genes or to achieve a more potent inhibition of a single target gene.

Alternatively, multiple targets are hit by the provision of one double-stranded RNA that hits multiple target sequences, and a single target is more efficiently inhibited by the presence of more than one copy of the double stranded RNA fragment corresponding to the target gene. Thus, in one embodiment of the invention, the double-stranded RNA construct comprises multiple dsRNA regions, at least one strand of each dsRNA region comprising a nucleotide sequence that is complementary to at least part of a target nucleotide sequence of an insect target gene. According to the invention, the dsRNA regions in the RNA construct may be complementary to the same or to different target genes and/or the dsRNA regions may be complementary to targets from the same or from different insect species.

The terms "hit", "hits" and "hitting" are alternative wordings to indicate that at least one of the strands of the dsRNA is complementary to, and as such may bind to, the target gene or nucleotide sequence.

In one embodiment, the double stranded RNA region comprises multiple copies of the nucleotide sequence that is complementary to the target gene. Alternatively, the dsRNA hits more than one target sequence of the same target gene. The invention thus encompasses isolated double stranded RNA constructs comprising at least two copies of said nucleotide sequence complementary to at least part of a nucleotide sequence of an insect target.

The term "multiple" in the context of the present invention means at least two, at least three, at least four, at least five, at least six, etc.

The expressions "a further target gene" or "at least one other target gene" mean for instance a second, a third or a fourth, etc. target gene.

DsRNA that hits more than one of the above-mentioned targets, or a combination of different dsRNA against different of the above mentioned targets are developed and used in the methods of the present invention.

Accordingly the invention relates to an isolated double stranded RNA construct comprising at least two copies of the RNA equivalent of at least one of the nucleotide sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or at least two copies of the RNA equivalent of a fragment of at least 17 basepairs in length thereof, preferably at least 18, 19, 20 or 21, more preferably at least 22, 23 or 24 basepairs in length thereof. Preferably, said double-stranded RNA comprises the RNA equivalent of the nucleotide sequence as represented in SEQ ID NO 159 or 160, or a fragment of at least 17, preferably at least 18, 19, 20 or 21, more preferably at least 22, 23 or 24 basepairs in length thereof. In a further embodiment, the invention relates to an isolated double stranded RNA construct comprising at least two copies of the RNA equivalent of the nucleotide sequence as represented by SEQ ID NO 159 or 160.

Accordingly, the present invention extends to methods as described herein, wherein the dsRNA comprises annealed complementary strands, one of which has a nucleotide sequence which is complementary to at least part of a target nucleotide sequence of an insect target gene, and which comprises the RNA equivalents of at least wo nucleotide sequences independently chosen from each other. In one embodiment, the dsRNA comprises the RNA equivalents of at least two, preferably at least three, four or five, nucleotide sequences independently chosen from the sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or fragments thereof of at least 17 basepairs in length, preferably at least 18, 19, 20 or 21, more preferably at least 22, 23 or 24 basepairs in length thereof.

The at least two nucleotide sequences may be derived from the target genes herein described. According to one preferred embodiment the dsRNA hits at least one target gene that is essential for viability, growth, development or reproduction of the insect and hits at least one gene involved in pathogenicity or infectivity as described hereinabove. Alternatively, the dsRNA hits multiple genes of the same category, for example, the dsRNA hits at least 2 essential genes or at least 2 genes involved in the same cellular function. According to a further embodiment, the dsRNA hits at least 2 target genes, which target genes are involved in a different cellular function. For example the dsRNA hits two or more genes involved in protein synthesis (e.g. ribosome subunits), intracellular protein transport, nuclear mRNA splicing, or involved in one of the functions described in Table 1A.

Preferably, the present invention extends to methods as described herein, wherein said insect target gene comprises a sequence which is which is selected from the group comprising:
  (i) sequences which are at least 75% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, and
  (ii) sequences comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, or wherein said insect target gene is an insect orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or the complement thereof.

The dsRNA regions (or fragments) in the double stranded RNA may be combined as follows:
  a) when multiple dsRNA regions targeting a single target gene are combined, they may be combined in the original order (ie the order in which the regions appear in the target gene) in the RNA construct,
  b) alternatively, the original order of the fragments may be ignored so that they are scrambled and combined randomly or deliberately in any order into the double stranded RNA construct,
  c) alternatively, one single fragment may be repeated several times, for example from 1 to 10 times, e.g. 1, 2, 3, 4, 5, 6, 7, 8, 9 or 10 times, in the ds RNA construct, or
  d) the dsRNA regions (targeting a single or different target genes) may be combined in the sense or antisense orientation.

In addition, the target gene(s) to be combined may be chosen from one or more of the following categories of genes:
  e) "essential" genes or "pathogenicity genes" as described above encompass genes that are vital for one or more target insects and result in a lethal or severe (e.g. feeding, reproduction, growth) phenotype when silenced. The choice of a strong lethal target gene results in a potent RNAi effect. In the RNA constructs of the invention, multiple dsRNA regions targeting the same or different (very effective) lethal genes can be combined to further increase the potency, efficacy or speed of the RNAi effect in insect control.
  f) "weak" genes encompass target genes with a particularly interesting function in one of the cellular pathways described herein, but which result in a weak phenotypic effect when silenced independently. In the RNA constructs of the invention, multiple dsRNA regions targeting a single or different weak gene(s) may be combined to obtain a stronger RNAi effect.
  g) "insect specific" genes encompass genes that have no substantial homologous counterpart in non-insect organisms as can be determined by bioinformatics homology searches, for example by BLAST searches. The choice of an insect specific target gene results in a species specific RNAi effect, with no effect or no substantial (adverse) effect in non-target organisms.
  h) "conserved genes" encompass genes that are conserved (at the amino acid level) between the target organism and non-target organism(s). To reduce possible effects on non-target species, such effective but conserved genes are analysed and target sequences from the variable regions of these conserved genes are chosen to be targeted by the dsRNA regions in the RNA construct. Here, conservation is assessed at the level of the nucleic acid sequence. Such variable regions thus encompass the least conserved sections, at the level of the nucleic acid sequence, of the conserved target gene(s).

i) "conserved pathway" genes encompass genes that are involved in the same biological pathway or cellular process, or encompass genes that have the same functionality in different insect species resulting in a specific and potent RNAi effect and more efficient insect control;

j) alternatively, the RNA constructs according to the present invention target multiple genes from different biological pathways, resulting in a broad cellular RNAi effect and more efficient insect control.

According to the invention, all double stranded RNA regions comprise at least one strand that is complementary to at least part or a portion of the nucleotide sequence of any of the target genes herein described. However, provided one of the double stranded RNA regions comprises at least one strand that is complementary to a portion of the nucleotide sequence of any one of the target genes herein described, the other double stranded RNA regions may comprise at least one strand that is complementary to a portion of any other insect target gene (including known target genes).

According to yet another embodiment of the present invention there is provided an isolated double stranded RNA or RNA construct as herein described, further comprising at least one additional sequence and optionally a linker. In one embodiment, the additional sequence is chosen from the group comprising (i) a sequence facilitating large-scale production of the dsRNA construct; (ii) a sequence effecting an increase or decrease in the stability of the dsRNA; (iii) a sequence allowing the binding of proteins or other molecules to facilitate uptake of the RNA construct by insects; (iv) a sequence which is an aptamer that binds to a receptor or to a molecule on the surface or in the cytoplasm of an insect to facilitate uptake, endocytosis and/or transcytosis by the insect; or (v) additional sequences to catalyze processing of dsRNA regions. In one embodiment, the linker is a conditionally self-cleaving RNA sequence, preferably a pH sensitive linker or a hydrophobic sensitive linker. In one embodiment, the linker is an intron.

In one embodiment, the multiple dsRNA regions of the double-stranded RNA construct are connected by one or more linkers. In another embodiment, the linker is present at a site in the RNA construct, separating the dsRNA regions from another region of interest. Different linker types for the dsRNA constructs are provided by the present invention.

In another embodiment, the multiple dsRNA regions of the double-stranded RNA construct are connected without linkers.

In a particular embodiment of the invention, the linkers may be used to disconnect smaller dsRNA regions in the pest organism. Advantageously, in this situation the linker sequence may promote division of a long dsRNA into smaller dsRNA regions under particular circumstances, resulting in the release of separate dsRNA regions under these circumstances and leading to more efficient gene silencing by these smaller dsRNA regions. Examples of suitable conditionally self-cleaving linkers are RNA sequences that are self-cleaving at high pH conditions. Suitable examples of such RNA sequences are described by Borda et al. (Nucleic Acids Res. 2003 May 15; 31(10):2595-600), which document is incorporated herein by reference. This sequence originates from the catalytic core of the hammerhead ribozyme HH16.

In another aspect of the invention, a linker is located at a site in the RNA construct, separating the dsRNA regions from another, e.g. the additional, sequence of interest, which preferably provides some additional function to the RNA construct.

In one particular embodiment of the invention, the dsRNA constructs of the present invention are provided with an aptamer to facilitate uptake of the dsRNA by the insect. The aptamer is designed to bind a substance which is taken up by the insect. Such substances may be from an insect or plant origin. One specific example of an aptamer, is an aptamer that binds to a transmembrane protein, for example a transmembrane protein of an insect. Alternatively, the aptamer may bind a (plant) metabolite or nutrient which is taken up by the insect.

Alternatively, the linkers are self-cleaving in the endosomes. This may be advantageous when the constructs of the present invention are taken up by the insect via endocytosis or transcytosis, and are therefore compartmentalized in the endosomes of the insect species. The endosomes may have a low pH environment, leading to cleavage of the linker.

The above mentioned linkers that are self-cleaving in hydrophobic conditions are particularly useful in dsRNA constructs of the present invention when used to be transferred from one cell to another via the transit in a cell wall, for example when crossing the cell wall of an insect pest organism.

An intron may also be used as a linker. An "intron" as used herein may be any non-coding RNA sequence of a messenger RNA. Particular suitable intron sequences for the constructs of the present invention are (1) U-rich (35-45%); (2) have an average length of 100 bp (varying between about 50 and about 500 bp) which base pairs may be randomly chosen or may be based on known intron sequences; (3) start at the 5' end with -AG:GT- or -CG:GT- and/or (4) have at their 3' end -AG:GC- or -AG:AA.

A non-complementary RNA sequence, ranging from about 1 base pair to about 10,000 base pairs, may also be used as a linker.

Without wishing to be bound by any particular theory or mechanism, it is thought that long double-stranded RNAs are taken up by the insect from their immediate environment. Double-stranded RNAs taken up into the gut and transferred to the gut epithelial cells are then processed within the cell into short double-stranded RNAs, called small interfering RNAs (siRNAs), by the action of an endogenous endonuclease. The resulting siRNAs then mediate RNAi via formation of a multi-component RNase complex termed the RISC or RNA interfering silencing complex.

In order to achieve down-regulation of a target gene within an insect cell the double-stranded RNA added to the exterior of the cell wall may be any dsRNA or dsRNA construct that can be taken up into the cell and then processed within the cell into siRNAs, which then mediate RNAi, or the RNA added to the exterior of the cell could itself be an siRNA that can be taken up into the cell and thereby direct RNAi.

siRNAs are generally short double-stranded RNAs having a length in the range of from 19 to 25 base pairs, or from 20 to 24 base pairs. In preferred embodiments siRNAs having 19, 20, 21, 22, 23, 24 or 25 base pairs, and in particular 21 or 22 base pairs, corresponding to the target gene to be down-regulated may be used. However, the invention is not intended to be limited to the use of such siRNAs.

siRNAs may include single-stranded overhangs at one or both ends, flanking the double-stranded portion. In a particularly preferred embodiment the siRNA may contain 3' overhanging nucleotides, preferably two 3' overhanging thymidines (dTdT) or uridines (UU). 3' TT or UU overhangs may be included in the siRNA if the sequence of the target gene immediately upstream of the sequence included in double-stranded part of the dsRNA is AA. This allows the TT or UU overhang in the siRNA to hybridise to the target gene. Although a 3' TT or UU overhang may also be included at the other end of the siRNA it is not essential for the target sequence downstream of the sequence included in double-stranded part of the siRNA to have AA. In this context, siRNAs which are RNA/DNA chimeras are also contemplated. These chimeras include, for example, the siRNAs comprising a double-stranded RNA with 3' overhangs of DNA bases (e.g. dTdT), as discussed above, and also double-stranded RNAs which are polynucleotides in which one or more of the RNA bases or ribonucleotides, or even all of the ribonucleotides on an entire strand, are replaced with DNA bases or deoxynucleotides.

The dsRNA may be formed from two separate (sense and antisense) RNA strands that are annealed together by (non-covalent) basepairing. Alternatively, the dsRNA may have a foldback stem-loop or hairpin structure, wherein the two annealed strands of the dsRNA are covalently linked. In this embodiment the sense and antisense stands of the dsRNA are formed from different regions of single polynucleotide molecule that is partially self-complementary. RNAs having this structure are convenient if the dsRNA is to be synthesised by expression in vivo, for example in a host cell or organism as discussed below, or by in vitro transcription. The precise nature and sequence of the "loop" linking the two RNA strands is generally not material to the invention, except that it should not impair the ability of the double-stranded part of the molecule to mediate RNAi. The features of "hairpin" or "stem-loop" RNAs for use in RNAi are generally known in the art (see for example WO 99/53050, in the name of CSIRO, the contents of which are incorporated herein by reference). In other embodiments of the invention, the loop structure may comprise linker sequences or additional sequences as described above.

Another aspect of the present invention are target nucleotide sequences of the insect target genes herein disclosed. Such target nucleotide sequences are particularly important to design the dsRNA constructs according to the present invention. Such target nucleotide sequences are preferably at least 17, preferably at least 18, 19, 20 or 21, more preferably at least 22, 23 or 24 nucleotides in length. Non-limiting examples of preferred target nucleotide sequences are given in the examples.

According to one embodiment, the present invention provides an isolated nucleotide sequence encoding a double stranded RNA or double stranded RNA construct as described herein.

According to a more specific embodiment, the present invention relates to an isolated nucleic acid sequence consisting of a sequence represented by any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or a fragment of at least 17 preferably at least 18, 19, 20 or 21, more preferably at least 22, 23 or 24 nucleotides thereof.

A person skilled in the art will recognize that homologues of these target genes can be found and that these homologues are also useful in the methods of the present invention.

Protein, or nucleotide sequences are likely to be homologous if they show a "significant" level of sequence similarity or more preferably sequence identity. Truely homologous sequences are related by divergence from a common ancestor gene. Sequence homologues can be of two types: (i) where homologues exist in different species they are known as orthologues. e.g. the α-globin genes in mouse and human are orthologues. (ii) paralogues are homologous genes in within a single species. e.g. the α- and β-globin genes in mouse are paralogues Preferred homologues are genes comprising a sequence which is at least about 85% or 87.5%, still more preferably about 90%, still more preferably at least about 95% and most preferably at least about 99% identical to a sequence selected from the group of sequences represented by SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof. Methods for determining sequence identity are routine in the art and include use of the Blast software and EMBOSS software (The European Molecular Biology Open Software Suite (2000), Rice, P. Longden, I. and Bleasby, A. Trends in Genetics 16, (6) pp 276-277). The term "identity" as used herein refers to the relationship between sequences at the nucleotide level. The expression "% identical" is determined by comparing optimally aligned sequences, e.g. two or more, over a comparison window wherein the portion of the sequence in the comparison window may comprise insertions or deletions as compared to the reference sequence for optimal alignment of the sequences. The reference sequence does not comprise insertions or deletions. The reference window is chosen from between at least 10 contiguous nucleotides to about 50, about 100 or to about 150 nucleotides, preferably between about 50 and 150 nucleotides. "% identity" is then calculated by determining the number of nucleotides that are identical between the sequences in the window, dividing the number of identical nucleotides by the number of nucleotides in the window and multiplying by 100.

Other homologues are genes which are alleles of a gene comprising a sequence as represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481. Further preferred homologues are genes comprising at least one single nucleotide polymorphism (SNIP) compared to a gene comprising a sequence as represented by any of SEQ ID NO 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481.

According to another embodiment, the invention encompasses target genes which are insect orthologues of a gene comprising a nucleotide sequence as represented in any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481. By way of example, orthologues may comprise a nucleotide sequence as represented in any of SEQ ID NOs 49 to 123, 275 to 434, 533 to 562, 621 to 738, 813 to 852, 908 to 1010, 1161 to 1437, 1730 to 1987, 2120 to 2290, and 2384 to 2438, or a fragment thereof of at least 17, 18, 19, 20, 21, 22, 23, 24, 25, 26 or 27 nucleotides. A non-limiting list of insect or arachnida orthologues genes or sequences comprising at least a fragment of 17 bp of one of the sequences of the invention, is given in Tables 4.

According to another embodiment, the invention encompasses target genes which are nematode orthologues of a gene comprising a nucleotide sequence as represented in any of 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 248. By way of example, nematode orthologues may comprise a nucleotide sequence as represented in any of SEQ ID NOs 124 to 135, 435 to 446, 563 to 564, 739 to 751, 853, 854, 1011 to 1025, 1438 to 1473, 1988 to 2001, 2291 to 2298, 2439 or 2440, or a fragment of at least 17, 18, 19, 20 or 21 nucleotides thereof. According to another aspect, the invention thus encompasses any of the methods described herein for controlling nematode growth in an organism, or for preventing nematode infestation of an organism susceptible to nemataode infection, comprising contacting nematode cells with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 124 to 135, 435 to 446, 563 to 564, 739 to 751, 853, 854, 1011 to 1025, 1438 to 1473, 1988 to 2001, 2291 to 2298, 2439 or 2440, whereby the double-stranded RNA is taken up by the nematode and thereby controls growth or prevents infestation. The invention also relates to nematode-resistant transgenic plants comprising a fragment of at least 17, 18, 19, 20 or 21 nucleotides of any of the sequences as represented in SEQ ID NOs 124 to 135, 435 to 446, 563 to 564, 739 to 751, 853, 854, 1011 to 1025, 1438 to 1473, 1988 to 2001, 2291 to 2298, 2439 or 2440. A non-limiting list of nematode orthologues genes or sequences comprising at least a fragment of 17 bp of one of the sequences of the invention, is given in Tables 5.

According to another embodiment, the invention encompasses target genes which are fungal orthologues of a gene comprising a nucleotide sequence as represented in any of 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481. By way of example, fungal orthologues may comprise a nucleotide sequence as represented in any of SEQ ID NOs 136 to 158, 447 to 472, 565 to 575, 752 to 767, 855 to 862, 1026 to 1040, 1475 to 1571, 2002 to 2039, 2299 to 2338, 2441 to 2460, or a fragment of at least 17, 18, 19, 20, 21, 22, 23, 24, 25, 26 or 27 nucleotides thereof. According to another aspect, the invention thus encompasses any of the methods described herein for controlling fungal growth on a cell or an organism, or for preventing fungal infestation of a cell or an organism susceptible to fungal infection, comprising contacting fungal cells with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 136 to 158, 447 to 472, 565 to 575, 752 to 767, 855 to 862, 1026 to 1040, 1475 to 1571, 2002 to 2039, 2299 to 2338, 2441 to 2460, whereby the double-stranded RNA is taken up by the fungus and thereby controls growth or prevents infestation. The invention also relates to fungal-resistant transgenic plants comprising a fragment of at least 17, 18, 19, 20 or 21 of any of the sequences as represented in SEQ ID NOs 136 to 158, 447 to 472, 565 to 575, 752 to 767, 855 to 862, 1026 to 1040, 1475 to 1571, 2002 to 2039, 2299 to 2338, 2441 to 2460. A non-limiting list of fungal orthologues genes or sequences comprising at least a fragment of 17 bp of one of the sequences of the invention, is given in Tables 6.

In one preferred embodiment of the invention the dsRNA may be expressed by (e.g. transcribed within) a host cell or host organism, the host cell or organism being an organism susceptible or vulnerable to infestation by an insect. In this embodiment RNAi-mediated gene silencing of one or more target genes in the insect may be used as a mechanism to control growth of the insect in or on the host organism and/or to prevent or reduce insect infestation of the host organism. Thus, expression of the double-stranded RNA within cells of the host organism may confer resistance to a particular insect or to a class of insects. In case the dsRNA hits more than one insect target gene, expression of the double-stranded RNA within cells of the host organism may confer resistance to more than one insect or more than one class of insects.

In a preferred embodiment the host organism is a plant and the insect is a plant pathogenic insect. In this embodiment the insect is contacted with the double-stranded RNA by expressing the double-stranded RNA in a plant or plant cell that is infested with or susceptible to infestation with the plant pathogenic insect.

In this context the term "plant" encompasses any plant material that it is desired to treat to prevent or reduce insect growth and/or insect infestation. This includes, inter alia, whole plants, seedlings, propagation or reproductive material such as seeds, cuttings, grafts, explants, etc. and also plant cell and tissue cultures. The plant material should express, or have the capability to express, dsRNA corresponding to one or more target genes of the insect.

Therefore, in a further aspect the invention provides a plant, preferably a transgenic plant, or propagation or reproductive material for a (transgenic) plant, or a plant cell culture expressing or capable of expressing at least one double-stranded RNA, wherein the double-stranded RNA comprises annealed complementary strands, one of which has a nucleotide sequence which is complementary to at least part of a target nucleotide sequence of a target gene of an insect, such that the double-stranded RNA is taken up by an insect upon plant-insect interaction, said double stranded RNA being capable of inhibiting the target gene or down-regulating expression of the target gene by RNA interference. The target gene may be any of the target genes herein described, for instance a target gene that is essential for the viability, growth, development or reproduction of the insect.

In this embodiment the insect can be any insect, but is preferably plant pathogenic insect. Preferred plant pathogenic insects include, but are not limited to, those listed above.

A plant to be used in the methods of the invention, or a transgenic plant according to the invention encompasses any plant, but is preferably a plant that is susceptible to infestation by a plant pathogenic insect.

Accordingly, the present invention extends to methods as described herein wherein the plant is chosen from the following group of plants (or crops): alfalfa, apple, apricot, artichoke, asparagus, avocado, banana, barley, beans, beet, blackberry, blueberry, broccoli, brussel sprouts, cabbage, canola, carrot, cassava, cauliflower, a cereal, celery, cherry, citrus, clementine, coffee, corn, cotton, cucumber, eggplant, endive, eucalyptus, figes, grape, grapefruit, groundnuts, ground cherry, kiwifruit, lettuce, leek, lemon, lime, pine, maize, mango, melon, millet, mushroom, nut aot, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugarbeet, sugarcane, sunflower, sweet potato, tangerine, tea, tobacco, tomato, a vine, watermelon, wheat, yams and zucchini.

In one embodiment the present invention extends to methods as described herein, wherein the plant is potato and the target gene is a gene from an insect selected from the group consisting of *Leptinotarsa* spp. (e.g. *L. decemlineata* (Colorado potato beetle), *L. juncta* (false potato beetle), or *L. texana* (Texan false potato beetle)); *Lema* spp. (e.g. *L. trilineata* (three-lined potato beetle)); *Epitrix* spp. (e.g. *E. cucumeris* (potato flea beetle) or *E. tuberis* (tuber flea beetle)); *Epicauta* spp. (e.g. *E. vittata* (striped blister beetle)); *Phaedon* spp. (e.g. *P. cochleariae* (mustard leaf beetle)); *Empoasca* spp. (e.g. *E. fabae* (potato leafhopper)); *Myzus* spp. (e.g. *M. persicae* (green peach aphid)); *Paratrioza* spp. (e.g. *P. cockerelli* (potato psyllid)); *Ostrinia* spp. (e.g. *O. nubilalis* (European corn borer)); *Conoderus* spp. (e.g. *C. falli* (southern potato wireworm), or *C. vespertinus* (tobacco wireworm)); and *Phthorimaea* spp. (e.g. *P. operculella* (potato tuberworm)); in another embodiment the present invention extends to methods as described herein, wherein the plant is tomato and the target gene is a gene from an insect selected from the group consisting of: *Macrosiphum* spp. (e.g. *M. euphorbiae* (potato aphid)); *Myzus* spp. (e.g. *M. persicae* (green peach aphid)); *Trialeurodes* spp. (e.g. *T. vaporariorum* (greenhouse whitefly), or *T. abutilonia* (banded-winged whitefly)); *Bemisia* spp. (e.g. *B. argentifolii* (silverleaf whitefly)); *Frankliniella* spp. (e.g. *F. occidentalis* (western flower thrips)); *Leptinotarsa* spp. (e.g. *L. decemlineata* (Colorado potato beetle), *L. juncta* (false potato beetle), or *L. texana* (Texan false potato beetle)); *Epitrix* spp. (e.g. *E. hirtipennis* (flea beetle)); *Lygus* spp. (e.g. *L. lineolaris* (tarnished plant bug), or *L. hesperus* (western tarnished plant bug)); *Euschistus* spp. (e.g. *E. conspresus* (conspersed stinkbug)); *Nezara* spp. (e.g. *N. viridula* (southern green stinkbug)); *Thyanta* spp. (e.g. *T. pallidovirens* (redshouldered stinkbug)); *Phthorimaea* spp. (e.g. *P. operculella* (potato tuberworm)); *Helicoverpa* spp. (e.g. *H. zea* (tomato fruitworm); *Keiferia* spp. (e.g. *K. lycopersicella* (tomato pinworm)); *Spodoptera* spp. (e.g. *S. exigua* (beet armyworm), or *S. praefica* (western yellow-striped armyworm)); *Limonius* spp. (wireworms); *Agrotis* spp. (e.g. *A. ipsilon* (black cutworm)); *Manduca* spp. (e.g. *M. sexta* (tobacco hornworm), or *M. quinquemaculata* (tomato hornworm)); *Liriomyza* spp. (e.g. *L. sativae*, *L. trifolli* or *L. huidobrensis* (leafminer)); and *Paratrioza* spp. (e.g. *P. cockerelli* (tomato psyllid)); In another embodiment the present invention extends to methods as described herein, wherein the plant is corn and the target gene is a gene from an insect selected from the group consisting of: *Diabrotica* spp. (e.g. *D. virgifera virgifera* (western corn rootworm), *D. barberi* (northern corn rootworm), *D. undecimpunctata howardi* (southern corn rootworm), *D. virgifera zeae* (Mexican corn rootworm); *D. balteata* (banded cucumber beetle)); *Ostrinia* spp. (e.g. *O. nubilalis* (European corn borer)); *Agrotis* spp. (e.g. *A. ipsilon* (black cutworm)); *Helicoverpa* spp. (e.g. *H. zea* (corn earworm)); *Spodoptera* spp. (e.g. *S. frugiperda* (fall armyworm)); *Diatraea* spp. (e.g. *D. grandiosella* (southwestern corn borer), or *D. saccharalis* (sugarcane borer)); *Elasmopalpus* spp. (e.g. *E. lignosellus* (lesser cornstalk borer)); *Melanotus* spp. (wireworms); *Cyclocephala* spp. (e.g. *C. borealis* (northern masked chafer)); *Cyclocephala* spp. (e.g. *C. immaculate* (southern masked chafer)); *Popillia* spp. (e.g. *P. japonica* (Japanese beetle)); *Chaetocnema* spp. (e.g. *C. pulicaria* (corn flea beetle)); *Sphenophorus* spp. (e.g. *S. maidis* (maize billbug)); *Rhopalosiphum* spp. (e.g. *R. maidis* (corn leaf aphid)); *Anuraphis* spp. (e.g. *A. maidiradicis* (corn root aphid)); *Blissus* spp. (e.g. *B. leucopterus leucopterus* (chinch bug)); *Melanoplus* spp. (e.g. *M. femurrubrum* (redlegged grasshopper), *M. sanguinipes* (migratory grasshopper)); *Hylemya* spp. (e.g. *H. platura* (seedcorn maggot)); *Agromyza* spp. (e.g. *A. parvicornis* (corn blot leafminer)); *Anaphothrips* spp. (e.g. *A. obscrurus* (grass thrips)); *Solenopsis* spp. (e.g. *S. milesta* (thief ant)); and *Tetranychus* spp. (e.g. *T. urticae* (twospotted spider mite)); in another embodiment the present invention extends to methods as described herein, wherein the plant is cotton and the target gene is a gene from an insect selected from the group consisting of: *Helicoverpa* spp. (e.g. *H. zea* (cotton bollworm)); *Pectinophora* spp. (e.g. *P. gossypiella* (pink bollworm)); *Helicoverpa* spp. (e.g. *H. armigera* (American bollworm)); *Earias* spp. (e.g. *E. vittella* (spotted bollworm)); *Heliothis* spp. (e.g. *H. virescens* (tobacco budworm)); *Spodoptera* spp. (e.g. *S. exigua* (beet armyworm)); *Anthonomus* spp. (e.g. *A. grandis* (boll weevil)); *Pseudatomoscelis* spp. (e.g. *P. seriatus* (cotton fleahopper)); *Trialeurodes* spp. (e.g. *T. abutiloneus* (banded-winged whitefly) *T. vaporariorum* (greenhouse whitefly)); *Bemisia* spp. (e.g. *B. argentifolii* (silverleaf whitefly)); *Aphis* spp. (e.g. *A. gossypii* (cotton aphid)); *Lygus* spp. (e.g. *L. lineolaris* (tarnished plant bug) or *L. hesperus* (western tarnished plant bug)); *Euschistus* spp. (e.g. *E. conspersus* (conspersus stink bug)); *Chlorochroa* spp. (e.g. *C. sayi* (Say stinkbug)); *Nezara* spp. (e.g. *N. viridula* (green stinkbug)); *Thrips* spp. (e.g. *T. tabaci* (onion thrips)); *Franklinkiella* spp. (e.g. *F. fusca* (tobacco thrips), or *F. occidentalis* (western flower thrips)); *Melanoplus* spp. (e.g. *M. femurrubrum* (redlegged grasshopper), or *M. differentialis* (differential grasshopper)); and *Tetranychus* spp. (e.g. *T. cinnabarinus* (carmine spider mite), or *T. urticae* (twospotted spider mite)); in another embodiment the present invention extends to methods as described herein, wherein the plant is rice and the target gene is a gene from an insect selected from the group consisting of: *Nilaparvata* spp. (e.g. *N. lugens* (brown planthopper)); *Laodelphax* spp. (e.g. *L. striatellus* (small brown planthopper)); *Nephotettix* spp. (e.g. *N. virescens* or *N. cincticeps* (green leafhopper), or *N. nigropictus* (rice leafhopper)); *Sogatella* spp. (e.g. *S. furcifera* (white-backed planthopper)); *Blissus* spp. (e.g. *B. leucopterus leucopterus* (chinch bug)); *Scotinophora* spp. (e.g. *S. vermidulate* (rice blackbug)); *Acrosternum* spp. (e.g. *A. hilare* (green stink bug)); *Parnara* spp. (e.g. *P. guttata* (rice skipper)); *Chilo* spp. (e.g. *C. suppressalis* (rice striped stem borer), *C. auricilius* (gold-fringed stem borer), or *C. polychrysus* (dark-headed stem borer)); *Chilotraea* spp. (e.g. *C. polychrysa* (rice stalk borer)); *Sesamia* spp. (e.g. *S. inferens* (pink rice borer)); *Tryporyza* spp. (e.g. *T. innotata* (white rice borer)); *Tryporyza* spp. (e.g *T. incertulas* (yellow rice borer)); *Cnaphalocrocis* spp. (e.g. *C. medinalis* (rice leafroller)); *Agromyza* spp. (e.g. *A. oryzae* (leafminer)); *Diatraea* spp. (e.g. *D. saccharalis* (sugarcane borer)); *Narnaga* spp. (e.g. *N. aenescens* (green rice caterpillar)); *Xanthodes* spp. (e.g. *X. transverse* (green caterpillar)); *Spodoptera* spp. (e.g. *S. frugiperda* (fall armyworm)); *Mythimna* spp. (e.g. *Mythmna (Pseudaletia) seperata* (armyworm)); *Helicoverpa* spp. (e.g. *H. zea* (corn earworm)); *Colaspis* spp. (e.g. *C. brunnea* (grape colaspis)); *Lissorhoptrus* spp. (e.g. *L. oryzophilus* (rice water weevil)); *Echinocnemus* spp. (e.g. *E. squamos* (rice plant weevil)); *Diclodispa* spp. (e.g. *D. armigera* (rice hispa)); *Oulema* spp. (e.g. *O. oryzae* (leaf beetle); *Sitophilus* spp. (e.g. *S. oryzae* (rice weevil)); *Pachydiplosis* spp. (e.g. *P. oryzae* (rice gall midge)); *Hydrellia* spp. (e.g. *H. griseola* (small rice leafminer)); *Chlorops* spp. (e.g. *C. oryzae* (stem maggot)); and *Hydrellia* spp. (e.g. *H. sasakii* (rice stem maggot));

Transgenic plants according to the invention extend to all plant species specifically described above being resistant to the respective insect species as specifically described above. Preferred transgenic plants (or reproductive or propagation material for a transgenic plant, or a cultured transgenic plant cell) are plants (or reproductive or propagation material for a transgenic plant, or a cultured transgenic plant cell) wherein said plant comprises a nucleic acid sequence which is selected from the group comprising:

(i) sequences which are at least 75% identical to a sequence represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, and (ii) sequences comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 247, 249, 251, 253, 255, 257, 259, 275 to 472, 473, 478, 483, 488, 493, 498, 503, 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476 or 2481, or the complement thereof, or wherein said nucleic acid is an insect orthologue of a gene comprising at least 17 contiguous nucleotides of any of SEQ ID NOs 49 to 158, 275 to 472, 533 to 575, 621 to 767, 813 to 862, 908 to 1040, 1161 to 1571, 1730 to 2039, 2120 to 2338, 2384 to 2460, or the complement thereof.

The present invention also encompasses plants (or reproductive or propagation material for a transgenic plant, or a cultured transgenic plant cell) which express or are capable of expressing at least one of the nucleotides of the invention, for instance at least one of the nucleotide sequences represented in any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or the complement thereof, or comprising a fragment thereof comprising at least 17, preferably at least 18, 19, 20 or 21, more preferably at least 22, 23 or 24 nucleotides.

The plant may be provided in a form wherein it is actively expressing (transcribing) the double-stranded RNA in one or more cells, cell types or tissues. Alternatively, the plant may be "capable of expressing", meaning that it is transformed with a transgene which encodes the desired dsRNA but that the transgene is not active in the plant when (and in the form in which) the plant is supplied.

Therefore, according to another embodiment, a recombinant DNA construct is provided comprising the nucleotide sequence encoding the dsRNA or dsRNA construct according to the present invention operably linked to at least one regulatory sequence. Preferably, the regulatory sequence is selected from the group comprising constitutive promoters or tissue specific promoters as described below.

The target gene may be any target gene herein described. Preferably the regulatory element is a regulatory element that is active in a plant cell. More preferably, the regulatory element is originating from a plant. The term "regulatory sequence" is to be taken in a broad context and refers to a regulatory nucleic acid capable of effecting expression of the sequences to which it is operably linked.

Encompassed by the aforementioned term are promoters and nucleic acids or synthetic fusion molecules or derivatives thereof which activate or enhance expression of a nucleic acid, so called activators or enhancers. The term "operably linked" as used herein refers to a functional linkage between the promoter sequence and the gene of interest, such that the promoter sequence is able to initiate transcription of the gene of interest.

By way of example, the transgene nucleotide sequence encoding the double-stranded RNA could be placed under the control of an inducible or growth or developmental stage-specific promoter which permits transcription of the dsRNA to be turned on, by the addition of the inducer for an inducible promoter or when the particular stage of growth or development is reached.

Alternatively, the transgene encoding the double-stranded RNA is placed under the control of a strong constitutive promoter such as any selected from the group comprising the CaMV35S promoter, doubled CaMV35S promoter, ubiquitin promoter, actin promoter, rubisco promoter, GOS2 promoter, Figwort mosaic viruse (FMV) 34S promoter, cassava vein mosaic virus (CsVMV) promoter (Verdaguer B. et al, Plant Mol Biol. 1998 37(6):1055-67).

Alternatively, the transgene encoding the double-stranded RNA is placed under the control of a tissue specific promoter such as any selected from the group comprising root specific promoters of genes encoding PsMTA Class III chitinase, photosynthetic tissue-specific promoters such as promoters of cab1 and cab2, rbcS, gapA, gapB and ST-LS1 proteins, JAS promoters, chalcone synthase promoter and promoter of RJ39 from strawberry.

In another embodiment, the transgene encoding the double-stranded RNA is placed under the control of an insect-induced promoter, for instance the potato proteinase inhibitor II (PinII) promoter (Duan X et al, Nat Biotechnol. 1996, 14(4):494-8)); or a wounding, induced promoter, for instance the jasmonates and ethylene induced promoters, PDF1.2 promoter (Manners J M et al., Plant Mol Biol. 1998, 38(6):1071-80); or under a defense related promoter, for instance the salicylic acid induced promoters and plant-pathogenesis related protein (PR protein) promoters (PR1 promoter (Cornelissen B J et al., Nucleic Acids Res. 1987, 15(17):6799-811; COMT promoter (Toquin V et al, Plant Mol Biol. 2003, 52(3):495-509).

Furthermore, when using the methods of the present invention for developing transgenic plants resistant against insects, it might be beneficial to place the nucleic acid encoding the double-stranded RNA according to the present invention under the control of a tissue-specific promoter. In order to improve the transfer of the dsRNA from the plant cell to the pest, the plants could preferably express the dsRNA in a plant part that is first accessed or damaged by the plant pest. In case of plant pathogenic insects, preferred tissues to express the dsRNA are the leaves, stems, roots, and seeds. Therefore, in the methods of the present invention, a plant tissue-preferred promoter may be used, such as a leaf-specific promoter, a stem-specific promoter, a phloem-specific promoter, a xylem-specific promoter, a root-specific promoter, or a seed-specific promoter (sucrose transporter gene AtSUC promoter (Baud S et al., Plant J. 2005, 43(6): 824-36), wheat high molecular weight glutenin gene promoter (Robert L S et al., Plant Cell. 1989, 1(6):569-78.)). Suitable examples of a root specific promoter are PsMTA (Fordam-Skelton, A. P., et al., 1997 Plant Molecular Biology 34: 659-668.) and the Class III Chitinase promoter. Examples of leaf- and stem-specific or photosynthetic tissue-specific promoters that are also photoactivated are promoters of two chlorophyll binding proteins (cab1 and cab2) from sugar beet (Stahl D. J., et al., 2004 BMC Biotechnology 2004 4:31), ribulose-bisphosphate carboxylase (Rubisco), encoded by rbcS (Nomura M. et al., 2000 Plant Mol. Biol. 44: 99-106), A (gapA) and B (gapB) subunits of chloroplast glyceraldehyde-3-phosphate dehydrogenase (Conley T. R. et al. 1994 Mol. Cell Biol. 19: 2525-33; Kwon H. B. et al. 1994 Plant Physiol. 105: 357-67), promoter of the *Solanum tuberosum* gene encoding the leaf and stem specific (ST-LS1) protein (Zaidi M. A. et al., 2005 Transgenic Res. 14:289-98), stem-regulated, defense-inducible genes, such as JAS promoters (patent publication no. 20050034192/US-A1). An example of a flower-specific promoter is for instance, the chalcone synthase promoter (Faktor O. et al. 1996 Plant Mol. Biol. 32: 849) and an example of a fruit-specific promoter is for instance RJ39 from strawberry (WO 98 31812).

In yet other embodiments of the present invention, other promoters useful for the expression of dsRNA are used and include, but are not limited to, promoters from an RNA PolI, an RNA PolII, an RNA PolIII, T7 RNA polymerase or SP6 RNA polymerase. These promoters are typically used for in vitro-production of dsRNA, which dsRNA is then included in an antiinsecticidal agent, for example, in an anti-insecticidal liquid, spray or powder.

Therefore, the present invention also encompasses a method for generating any of the double-stranded RNA or RNA constructs of the invention. This method comprises the steps of
a. contacting an isolated nucleic acid or a recombinant DNA construct of the invention with cell-free components; or
b. introducing (e.g. by transformation, transfection or injection) an isolated nucleic acid or a recombinant DNA construct of the invention in a cell,
under conditions that allow transcription of said nucleic acid or recombinant DNA construct to produce the dsRNA or RNA construct.

Optionally, one or more transcription termination sequences may also be incorporated in the recombinant construct of the invention. The term "transcription termination sequence" encompasses a control sequence at the end of a transcriptional unit, which signals 3' processing and polyadenylation of a primary transcript and termination of transcription. Additional regulatory elements, such as transcriptional or translational enhancers, may be incorporated in the expression construct.

The recombinant constructs of the invention may further include an origin of replication which is required for maintenance and/or replication in a specific cell type. One example is when an expression construct is required to be maintained in a bacterial cell as an episomal genetic element (e.g. plasmid or cosmid molecule) in a cell. Preferred origins of replication include, but are not limited to, f1-ori and colE1 ori.

The recombinant construct may optionally comprise a selectable marker gene. As used herein, the term "selectable marker gene" includes any gene, which confers a phenotype on a cell in which it is expressed to facilitate the identification and/or selection of cells, which are transfected or transformed, with an expression construct of the invention. Examples of suitable selectable markers include resistance genes against ampicillin (Ampr), tetracycline (Tcr), kanamycin (Kanr), phosphinothricin, and chloramphenicol (CAT) gene. Other suitable marker genes provide a metabolic trait, for example manA. Visual marker genes may also be used and include for example beta-glucuronidase (GUS), luciferase and Green Fluorescent Protein (GFP).

Plants that have been stably transformed with a transgene encoding the dsRNA may be supplied as seed, reproductive material, propagation material or cell culture material which does not actively express the dsRNA but has the capability to do so.

Accordingly, the present invention encompasses a plant (e.g. a rice plant), or a seed (e.g. a rice seed), or a cell (e.g. a bacterial or plant cell), comprising at least one double-stranded RNA or at least one double-stranded RNA construct as described herein: or at least one nucleotide sequence or at least one recombinant DNA construct as descrobed herein; or at least one plant cell as described herein. The present invention also encompasses a plant (e.g. an alfalfa, apple, apricot, artichoke, asparagus, avocado, banana, barley, beans, beet, blackberry, blueberry, broccoli, brussel sprouts, cabbage, canola, carrot, cassava, cauliflower, a cereal, celery, cherry, citrus, clementine, coffee, corn, cotton, cucumber, eggplant, endive, eucalyptus, figes, grape, grapefruit, groundnuts, ground cherry, kiwifruit, lettuce, leek, lemon, lime, pine, maize, mango, melon, millet, mushroom, nut aot, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugarbeet, sugarcane, sunflower, sweet potato, tangerine, tea, tobacco, tomato, a vine, watermelon, wheat, yams or zucchini plant; preferably a potato, eggplant, tomato, pepper, tobacco, ground cherry, rice corn or cotton plant), or a seed or tuber (e.g. an alfalfa, apple, apricot, artichoke, asparagus, avocado, banana, barley, beans, beet, blackberry, blueberry, broccoli, brussel sprouts, cabbage, canola, carrot, cassava, cauliflower, a cereal, celery, cherry, citrus, clementine, coffee, corn, cotton, cucumber, eggplant, endive, eucalyptus, figes, grape, grapefruit, groundnuts, ground cherry, kiwifruit, lettuce, leek, lemon, lime, pine, maize, mango, melon, millet, mushroom, nut aot, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugarbeet, sugargcane, sunflower, sweet potato, tangerine, tea, tobacco, tomato, a vine, watermelon, wheat, yams or zucchini plant; preferably a potato, eggplant, tomato, pepper, tobacco, ground cherry, rice, corn or cotton seed or tuber), or a cell (e.g. a bacterial or plant cell), comprising at least one double-stranded RNA or at least one double-stranded RNA construct as described herein: or at least one nucleotide sequence or at least one recombinant DNA construct as descrobed herein. Preferably, these plants or seeds or cells comprise a recombinant construct wherein the nucleotide sequence encoding the dsRNA or dsRNA construct according to the present invention is operably linked to at least one regulatory element as described above.

The plant may be provided in a form wherein it is actively expressing (transcribing) the RNA molecule in one or more cells, cell types or tissues. Alternatively, the plant may be "capable of expressing", meaning that it is transformed with a transgene which encodes the desired RNA molecule but that the transgene is not active in the plant when (and in the form in which) the plant is supplied.

In one particular embodiment, there is provided a recombinant (expression) construct for expression of an RNA molecule in a plant or in a plant cell comprising at least one regulatory sequence operably linked to a nucleic acid molecule comprising at least 14, 15, 16, 17, 18, 19, 20, 21, 22 etc. nucleotides, up to all of the nucleotides of the sequence set forth as SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or comprising at least 14, 15, 16, 17, 18, 19, 20, 21, 22 etc. up to all nucleotides of the sequence of an orthologous nucleic acid molecule from a different target species. Many vectors are available for this purpose, and selection of the appropriate vector will depend mainly on the size of the nucleic acid to be inserted into the vector and the particular host cell to be transformed with the vector.

General techniques for expression of exogenous double-stranded RNA in plants for the purposes of RNAi are known in the art (see Baulcombe D, 2004, Nature. 431(7006):356-63. RNA silencing in plants, the contents of which are incorporated herein by reference). More particularly, methods for expression of double-stranded RNA in plants for the purposes of down-regulating gene expression in plant pests such as nematodes or insects are also known in the art. Similar methods can be applied in an analogous manner in order to express double-stranded RNA in plants for the purposes of down-regulating expression of a target gene in a plant pathogenic insect. In order to achieve this effect it is necessary only for the plant to express (transcribe) the double-stranded RNA in a part of the plant which will come into direct contact with the insect, such that the double-stranded RNA can be taken up by the insect. Depending on the nature of the insect and its relationship with the host plant, expression of the dsRNA could occur within a cell or tissue of a plant within which the insect is also present during its life cycle, or the RNA may be secreted into a space between cells, such as the apoplast, that is occupied by the insect during its life cycle. Furthermore, the dsRNA may be located in the plant cell, for example in the cytosol, or in the plant cell organelles such as a chloroplast, mitochondrion, vacuole or endoplastic reticulum.

Alternatively, the dsRNA may be secreted by the plant cell and by the plant to the exterior of the plant. As such, the dsRNA may form a protective layer on the surface of the plant.

In a further aspect, the invention also provides combinations of methods and compositions for preventing or protecting plants from pest infestation. For instance, one means provides using the plant transgenic approach combining methods using expression of dsRNA molecules and methods using expression of such Bt insecticidal proteins.

Therefore the invention also relates to a method or a plant cell or plant described herein, wherein said plant cell or plant expressing said RNA molecule comprises or expresses a pesticidal agent selected from the group consisting of a patatin, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein. Preferably said *Bacillus thuringiensis* insecticidal protein is selected from the group consisting of a Cry1, a Cry3, a TIC851, a CryET170, a Cry22, a binary insecticidal protein CryET33 and CryET34, a binary insecticidal protein CryET80 and CryET76, a binary insecticidal protein TIC100 and TIC101, and a binary insecticidal protein PS149B1.

In a further embodiment, the invention rela tes to a composition for controlling insect growth and/or preventing or reducing insect infestation, comprising at least a plant part, plant cell, plant tissue or seed comprising at least one double-stranded RNA, wherein said double-stranded RNA comprises annealed complementary strands, one of which has a nucleotide sequence which is complementary to at least part of a nucleotide sequence of an insect target gene. Optionally, the composition further comprises at least one suitable carrier, excipient or diluent. The target gene may be any target gene described herein. Preferably the insect target gene is essential for the viability, growth, development or reproduction of the insect.

In another aspect the invention relates to a composition as described above, wherein the insect target gene comprises a sequence which is at least 75%, preferably at least 80%, 85%, 90%, more preferably at least 95%, 98% or 99% identical to a sequence selected from the group of sequences represented by any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or the complement thereof, or wherein said insect target gene is an insect orthologue of a gene comprising at least 17 contiguous nucleotides of any of SEQ ID NOs 1, 3, 5, 7, 9, 11, 13, 15, 17, 19, 21, 23, 49 to 158, 159, 160-163, 168, 173, 178, 183, 188, 193, 198, 203, 208, 215, 220, 225, 230, 240 to 247, 249, 251, 253, 255, 257, 259, 275 to 472, 473, 478, 483, 488, 493, 498, 503, 508 to 513, 515, 517, 519, 521, 533 to 575, 576, 581, 586, 591, 596, 601, 603, 605, 607, 609, 621 to 767, 768, 773, 778, 783, 788, 793, 795, 797, 799, 801, 813 to 862, 863, 868, 873, 878, 883, 888, 890, 892, 894, 896, 908 to 1040, 1041, 1046, 1051, 1056, 1061, 1066 to 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1161 to 1571, 1572, 1577, 1582, 1587, 1592, 1597, 1602, 1607, 1612, 1617, 1622, 1627, 1632, 1637, 1642, 1647, 1652, 1657, 1662, 1667, 1672, 1677, 1682, 1684, 1686, 1688, 1690, 1692, 1694, 1696, 1698, 1700, 1702, 1704, 1730 to 2039, 2040, 2045, 2050, 2055, 2060, 2065, 2070, 2075, 2080, 2085, 2090, 2095, 2100, 2102, 2104, 2106, 2108, 2120 to 2338, 2339, 2344, 2349, 2354, 2359, 2364, 2366, 2368, 2370, 2372, 2384 to 2460, 2461, 2466, 2471, 2476, 2481 or 2486, or the complement thereof.

According to a still further embodiment, the present invention extends to a method for increasing plant yield comprising introducing in a plant any of the nucleotide sequences or recombinant DNA constructs as herein described in an expressible format. Plants encompassed by this method are as described earlier.

The invention will be further understood with reference to the following non-limiting examples.

BRIEF DESCRIPTION OF FIGURES AND TABLES

FIG. 1-LD: Survival of *L. decemlineata* on artificial diet treated with dsRNA. Insects of the second larval stage were fed diet treated with 50 µl of topically-applied solution of dsRNA (targets or gfp control). Diet was replaced with fresh diet containing topically-applied dsRNA after 7 days. The number of surviving insects were assessed at days 2, 5, 7, 8, 9, & 13. The percentage of surviving larvae was calculated relative to day 0 (start of assay). Target LD006: (SEQ ID NO 178); Target LD007 (SEQ ID NO 183); Target LD010 (SEQ ID NO 188); Target LD011 (SEQ ID NO 193); Target LD014 (SEQ ID NO 198); gfp dsRNA (SEQ ID NO 235).

FIG. 2-LD: Survival of *L. decemlineata* on artificial diet treated with dsRNA. Insects of the second larval stage were fed diet treated with 50 μl of topically-applied solution of dsRNA (targets or gfp control). Diet was replaced with fresh diet only after 7 days. The number of surviving insects was assessed at days 2, 5, 6, 7, 8, 9, 12, & 14. The percentage of surviving larvae was calculated relative to day 0 (start of assay). Target LD001 (SEQ ID NO 163); Target LD002 (SEQ ID NO 168); Target LD003 (SEQ ID NO 173); Target LD015 (SEQ ID NO 215); Target LD016 (SEQ ID NO 220); gfp dsRNA (SEQ ID NO 235).

FIG. 3-LD: Average weight of *L. decemlineata* larvae on potato leaf discs treated with dsRNA. Insects of the second larval stage were fed leaf discs treated with 20 μl of a topically-applied solution (10 ng/μl) of dsRNA (target LD002 or gfp). After two days the insects were transferred on to untreated leaves every day.

FIG. 4-LD: Survival of *L. decemlineata* on artificial diet treated with shorter versions of target LD014 dsRNA and concatemer dsRNA. Insects of the second larval stage were fed diet treated with 50 μl of topically-applied solution of dsRNA (gfp or targets). The number of surviving insects were assessed at days 3, 4, 5, 6, & 7. The percentage of surviving larvae were calculated relative to day 0 (start of assay).

FIG. 5-LD: Survival of *L. decemlineata* larvae on artificial diet treated with different concentrations of dsRNA of target LD002 (a), target LD007 (b), target LD010 (c), target LD011 (d), target LD014 (e), target LD015 (f), LD016 (g) and target LD027 (h). Insects of the second larval stage were fed diet treated with 50 μl of topically-applied solution of dsRNA. Diet was replaced with fresh diet containing topically-applied dsRNA after 7 days. The number of surviving insects were assessed at regular intervals. The percentage of surviving larvae were calculated relative to day 0 (start of assay).

FIG. 6-LD. Survival of *L. decemlineata* adults on potato leaf discs treated with dsRNA. Young adult insects were fed double-stranded-RNA-treated leaf discs for the first two days and were then placed on untreated potato foliage. The number of surviving insects were assessed regularly; mobile insects were recorded as insects which were alive and appeared to move normally; moribund insects were recorded as insects which were alive but appeared sick and slow moving—these insects were not able to right themselves once placed on their backs. Target LD002 (SEQ ID NO 168); Target LD010 (SEQ ID NO 188); Target LD014 (SEQ ID NO 198); Target LD016 (SEQ ID NO 220); gfp dsRNA (SEQ ID NO 235).

FIG. 7-LD. Mortality and growth/developmental delay of larval survivors of the Colorado potato beetle, *Leptinotarsa decemlineata*, on transgenic potato plants. Seven CPB L1 larvae were fed on transgenic potato siblings harbouring LD002 construct (●), empty vector (▲), or wild type line V plants (■) for seven days. Mortality is expressed in percentage and average larval weight in mg.

FIG. 1-PC: Effects of ingested target dsRNAs on survival and growth of *P. cochleariae* larvae. Neonate larvae were fed oilseed rape leaf discs treated with 25 μl of topically-applied solution of 0.1 μg/μl dsRNA (targets or gfp control). After 2 days, the insects were transferred onto fresh dsRNA-treated leaf discs. At day 4, larvae from one replicate for every treatment were collected and placed in a Petri dish containing fresh untreated oilseed rape foliage. The insects were assessed at days 2, 4, 7, 9 & 11. (a) Survival of *E. varivestis* larvae on oilseed rape leaf discs treated with dsRNA. The percentage of surviving larvae was calculated relative to day 0 (start of assay). (b) Average weights of *P. cochleariae* larvae on oilseed rape leaf discs treated with dsRNA. Insects from each replicate were weighed together and the average weight per larva determined. Error bars represent standard deviations. Target 1: SEQ ID NO 473; target 3: SEQ ID NO 478; target 5: SEQ ID NO 483; target 10: SEQ ID NO 488; target 14: SEQ ID NO 493; target 16: SEQ ID NO 498; target 27: SEQ ID NO 503; gfp dsRNA: SEQ ID NO 235.

FIG. 2-PC: Survival of *P. cochleariae* on oilseed rape leaf discs treated with different concentrations of dsRNA of (a) target PC010 and (b) target PC027. Neonate larvae were placed on leaf discs treated with 25 μl of topically-applied solution of dsRNA. Insects were transferred to fresh treated leaf discs at day 2. At day 4 for target PC010 and day 5 for target PC027, the insects were transferred to untreated leaves. The number of surviving insects were assessed at days 2, 4, 7, 8, 9 & 11 for PC010 and 2, 5, 8, 9 & 12 for PC027. The percentage of surviving larvae was calculated relative to day 0 (start of assay).

FIG. 1-EV: Survival of *E. varivestis* larvae on bean leaf discs treated with dsRNA. Neonate larvae were fed bean leaf discs treated with 25 μl of topically-applied solution of 1 μg/μl dsRNA (targets or gfp control). After 2 days, the insects were transferred onto fresh dsRNA-treated leaf discs. At day 4, larvae from one treatment were collected and placed in a plastic box containing fresh untreated bean foliage. The insects were assessed for mortality at days 2, 4, 6, 8 & 10. The percentage of surviving larvae was calculated relative to day 0 (start of assay). Target 5: SEQ ID NO 576; target 10: SEQ ID NO 586; target 15: SEQ ID NO 591; target 16: SEQ ID NO 596; gfp dsRNA: SEQ ID NO 235.

FIG. 2-EV: Effects of ingested target dsRNAs on survival of *E. varivestis* adults and resistance to snap bean foliar insect damage. (a) Survival of *E. varivestis* adults on bean leaf treated with dsRNA. Adults were fed bean leaf discs treated with 75 μl of topically-applied solution of 0.1 μg/μl dsRNA (targets or gfp control). After 24 hours, the insects were transferred onto fresh dsRNA-treated leaf discs. After a further 24 hours, adults from one treatment were collected and placed in a plastic box containing potted fresh untreated whole bean plants. The insects were assessed for mortality at days 4, 5, 6, 7, 8, & 11. The percentage of surviving adults was calculated relative to day 0 (start of assay). Target 10:

SEQ ID NO 586; target 15: SEQ ID NO 591; target 16: SEQ ID NO 596; gfp dsRNA: SEQ ID NO 235. (b) Resistance to bean foliar damage caused by adults of the *E. varivestis* by dsRNA. Whole plants containing insects from one treatment (see (a)) were checked visually for foliar damage on day 9. (i) target 10; (ii) target 15; (iii) target 16; (iv) gfp dsRNA; (v) untreated.

FIG. 1-TC: Survival of *T. castaneum* larvae on artificial diet treated with dsRNA of target 14. Neonate larvae were fed diet based on a flour/milk mix with 1 mg dsRNA target 14. Control was water (without dsRNA) in diet. Four replicates of 10 first instar larvae per replicate were performed for each treatment. The insects were assessed for survival as average percentage means at days 6, 17, 31, 45 and 60. The percentage of surviving larvae was calculated relative to day 0 (start of assay). Error bars represent standard deviations. Target TC014: SEQ ID NO 878.

FIG. 1-MP: Effect of ingested target 27 dsRNA on the survival of *Myzus persicae* nymphs. First instars were placed in feeding chambers containing 50 μl of liquid diet with 2 μg/μl dsRNA (target 27 or gfp dsRNA control). Per treatment, 5 feeding chambers were set up with 10 instars in each feeding chamber. Number of survivors were assessed at 8 days post start of bioassay. Error bars represent standard deviations. Target MP027: SEQ ID NO 1061; gfp dsRNA: SEQ ID NO 235.

FIG. 1-NL: Survival of *Nilaparvata lugens* on liquid artificial diet treated with dsRNA. Nymphs of the first to second larval stage were fed diet supplemented with 2 mg/ml solution of dsRNA targets in separate bioassays: (a) NL002, NL003, NL005, NL010; (b) NL009, NL016; (c) NL014, NL018; (d) NL013, NL015, NL021. Insect survival on targets were compared to diet only and diet with gfp dsRNA control at same concentration. Diet was replaced with fresh diet containing dsRNA every two days. The number of surviving insects were assessed every day FIG. 2-NL: Survival of *Nilaparvata lugens* on liquid artificial diet treated with different concentrations of target dsRNA NL002. Nymphs of the first to second larval stage were fed diet supplemented with 1, 0.2, 0.08, and 0.04 mg/ml (final concentration) of NL002. Diet was replaced with fresh diet containing dsRNA every two days. The numbers of surviving insects were assessed every day.

EXAMPLES

Example 1

Silencing *C. elegans* Target Genes in *C. elegans* in High Throughput Screening A *C. elegans* genome wide library was prepared in the pGN9A vector (WO 01/88121) between two identical T7-promoters and terminators, driving its expression in the sense and antisense direction upon expression of the T7 polymerase, which was induced by IPTG.

This library was transformed into the bacterial strain A13301-105 (DE3) in 96 well plate format. For the genome wide screening, these bacterial cells were fed to the nuclease deficient *C. elegans* nuc-1 (e1392) strain.

Feeding the dsRNA produced in the bacterial strain A13301-105 (DE3), to *C. elegans* nuc-1 (e1392) worms, was performed in a 96 well plate format as follows: nuc-1 eggs were transferred to a separate plate and allowed to hatch simultaneously at 20° C. for synchronization of the L1 generation. 96 well plates were filled with 100 μL liquid growth medium comprising IPTG and with 10 μL bacterial cell culture of $OD_{600}1$ A13301-105 (DE3) of the *C. elegans* dsRNA library carrying each a vector with a *C. elegans* genomic fragment for expression of the dsRNA. To each well, 4 of the synchronized L1 worms were added and were incubated at 25° C. for at least 4 to 5 days. These experiments were performed in quadruplicate. In the screen 6 controls were used:

pGN29=negative control, wild type
pGZ1=unc-22=twitcher phenotype
pGZ18=chitin synthase=embryonic lethal
pGZ25=pos-1=embryonic lethal
pGZ59=bli-4D=acute lethal
ACC=acetyl co-enzym A carboxylase=acute lethal After 5 days, the phenotype of the *C. elegans* nuc-1 (e1392) worms fed with the bacteria producing dsRNA were compared to the phenotype of worms fed with the empty vector (pGN29) and the other controls. The worms that were fed with the dsRNA were screened for lethality (acute or larval) lethality for the parent (Po) generation, (embryonic) lethality for the first filial (F1) generation, or for growth retardation of Po as follows: (i) Acute lethality of Po: L1's have not developed and are dead, this phenotype never gives progeny and the well looks quite empty; (ii) (Larval) lethality of Po: Po died in a later stage than L1, this phenotype also never gives progeny. Dead larvae or dead adult worms are found in the wells; (iii) Lethality for F1: L1's have developed until adult stage and are still alive. This phenotype has no progeny. This can be due to sterility, embryonic lethality (dead eggs on the bottom of well), embryonic arrest or larval arrest (eventually ends up being lethal): (iv) Arrested in growth and growth retardation/delay: Compared to a well with normal development and normal # of progeny.

For the target sequences presented in Table 1A, it was concluded that dsRNA mediated silencing of the *C. elegans* target gene in nematodes, such as *C. elegans*, had a fatal effect on the growth and viability of the worm.

Subsequent to the above dsRNA silencing experiment, a more detailed phenotyping experiment was conducted in *C. elegans* in a high throughput format on 24 well plates. The dsRNA library produced in bacterial strain AB301-105 (DE3), as described above, was fed to *C. elegans* nuc-1 (e1392) worms on 24 well plates as follows: nuc-1 eggs were transferred to a separate plate and allowed to hatch simultaneously at 20 C for synchronization of the L1 generation. Subsequently 100 of the synchronized L1 worms were soaked in a mixture of 500 μL S-complete fed medium, comprising 5 μg/mL cholesterol, 4 μL/mL PEG and 1 mM IPTG, and 500 μL of bacterial cell culture of $OD_{600}1$ AB301-105 (DE3) of the *C. elegans* dsRNA library carrying each a vector with a *C. elegans* genomic fragment for expression of the dsRNA. The soaked L1 worms were rolled for 2 hours at 25 C.

After centrifugation and removal of 950 μL of the supernatant, 5 μL of the remaining and resuspended pellet (comprising about 10 to 15 worms) was transferred in the middle of each well of a 24 well plate, filled with a layer of agar LB broth. The inoculated plate was incubated at 25° C. for 2 days. At the adult stage, 1 adult worm was singled and incubated at 25° C. for 2 days for inspection of its progeny. The other adult worms are inspected in situ on the original 24 well plate. These experiments were performed in quadruplicate.

This detailed phenotypic screen was repeated with a second batch of worms, the only difference being that the worms of the second batch were incubated at 20 C for 3 days.

The phenotype of the worms fed with *C. elegans* dsRNA was compared to the phenotype of *C. elegans* nuc-1 (e1392) worms fed with the empty vector.

Based on this experiment, it was concluded that silencing the *C. elegans* target genes as represented in Table 1A had a fatal effect on the growth and viability of the worm and that the target gene is essential to the viability of nematodes. Therefore these genes are good target genes to control (kill or prevent from growing) nematodes via dsRNA mediated gene silencing. Accordingly, the present invention encompasses the use of nematode orthologues of the above *C. elegans* target gene, to control nematode infestation, such as nematode infestation of plants.

Example 2

Identification of *D. melanogaster* Orthologues

As described above in Example 1, numerous *C. elegans* lethal sequences were identified and can be used for identifying orthologues in other species and genera. For example, the *C. elegans* lethal sequences can be used to identify orthologous *D. melanogasters* sequences. That is, each *C. elegans* sequence can be queried against a public database, such as GenBank, for orthologous sequences in *D. melanogaster*. Potential *D. melanogaster* orthologues were selected that share a high degree of sequence homology (E value preferably less than or equal to 1E-30) and the sequences are blast reciprocal best hits, the latter means that the sequences from different organisms (e.g. *C. elegans* and *D. melanogaster*) are each other's top blast hits. For example, sequence C from *C. elegans* is compared against sequences in *D. melanogaster* using BLAST. If sequence C has the *D. melanogaster* sequence D as best hit and when D is compared to all the sequences of *C. elegans*, also turns out to be sequence C, then D and C are reciprocal best hits. This criterium is often used to define orthology, meaning similar sequences of different species, having similar function. The *D. melanogaster* sequence identifiers are represented in Table 1A.

Example 3

*Leptinotarsa decemlineata* (Colorado Potato Beetle)

A. Cloning Partial Gene Sequences from *Leptinotarsa decemlineata*

High quality, intact RNA was isolated from 4 different larval stages of *Leptinotarsa decemlineata* (Colorado potato beetle; source: Jeroen van Schaik, Entocare CV Biologische Gewasbescherming, Postbus 162, 6700 AD Wageningen, the Netherlands) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the LD001, LD002, LD003, LD006, LD007, LD010, LD011, LD014, LD015, LD016, LC018 and LD027 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-LD, which displays *Leptintarsa decemlineata* target genes including primer sequences and cDNA sequences obtained. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen), and sequenced. The sequences of the resulting PCR products are represented by the respective SEQ ID NOs as given in Table 2-LD and are referred to as the partial sequences. The corresponding partial amino acid sequence are represented by the respective SEQ ID NOs as given in Table 3-LD, where the start of the reading frame is indicated in brackets.

B. dsRNA Production of the *Leptinotarsa decemlineata* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-LD. The conditions in the PCR reactions were as follows: 4 minutes at 95° C., followed by 35 cycles of 30 seconds at 95° C., 30 seconds at 55° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-LD. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-LD. Table 8-LD displays sequences for preparing ds RNA fragments of *Leptinotarsa decemlineata* target sequences and concatemer sequences, including primer sequences.

C. Cloning *Leptinotarsa decemlineata* Genes into Plant Vector pK7GWIWG2D(II)

Since the mechanism of RNA interference operates through dsRNA fragments, the target nucleotide sequences of the target genes, as selected above, were cloned in anti-sense and sense orientation, separated by the intron— CmR-intron, whereby CmR is the chloramphenicol resistance marker, to form a dsRNA hairpin construct. These hairpin constructs were generated using the LR recombination reaction between an attL-containing entry clone (see Example 1) and an attR-containing destination vector (=pK7GWIWG2D(II)). The plant vector pK7GWIWG2D (II) was obtained from the VIB/Plant Systems Biology with a Material Transfer Agreement. LR recombination reaction was performed by using LR Clonase™ II enzyme mix (Cat.

Nr. 11791-020, Invitrogen) following the manufacturer's instructions. These cloning experiments resulted in a hairpin construct for each of the LD002, LD006, LD007, LD010, LD011, LD014 and LD016 genes, having either the promoter—sense-intron-CmR-intron-antisense orientation, or promoter—antisense-intron-CmR-intron-sense orientation, and wherein the promoter is the plant operable 35S promoter. The binary vector pK7GWIWG2D(II) with the 35S promoter is suitable for transformation into *A. tumefaciens*.

For LD002 and LD010, a double digest with restriction enzymes BsoBI & PvuI was done on LD002 cloned into pCR8/GW/topo (see Example 3A). For LD006, LD007, LD011, LD014, LD016 and LD027, a digest with restriction enzyme BsoBI was done on LD006 cloned into pCR8/GW/topo (see Example 3A). The band containing the gene of interest flanked by the attL sites using Qiaquick Gel Extraction Kit (Cat. Nr. 28706, Qiagen) was purified. An amount of 150 ng of purified fragment and 150 ng pK7GWIWG2D (II) was added together with the LR clonase II enzyme and incubated for at least 1 h at 25° C. After proteinase K solution treatment (10 min at 37° C.), the whole recombination mix was transformed into Top 10 chemically competent cells. Positive clones were selected by restriction digest analysis. The complete sequence of the hairpin construct for:

LD002 (antisense-intron-CmR-intron-sense) is set forth in SEQ ID NO 240;
LD006 (sense-intron-CmR-intron-antisense) is set forth in SEQ ID NO 241;
LD007 sense-intron-CmR-intron-antisense) is set forth in SEQ ID NO 242;
LD010 (antisense-intron-CmR-intron-sense) is set forth in SEQ ID NO 243;
LD011 (sense-intron-CmR-intron-antisense) is set forth in SEQ ID NO 244;
LD014 (sense-intron-CmR-intron-antisense) is set forth in SEQ ID NO 245;
LD016 (antisense-intron-CmR-intron-sense) is set forth in SEQ ID NO 246;
LD027 (sense-intron-CmR-intron-antisense) is set forth in SEQ ID NO 2486.

Table 9-LD provides complete sequences for each hairpin construct.

D. Screening dsRNA Targets Using Artificial Diet for Activity Against *Leptinotarsa decemlineata*

Artificial diet for the Colorado potato beetle was prepared as follows (adapted from Gelman et al., 2001, J. Ins. Sc., vol. 1, no. 7, 1-10): water and agar were autoclaved, and the remaining ingredients (shown in Table A below) were added when the temperature dropped to 55° C. At this temperature, the ingredients were mixed well before the diet was aliquoted into 24-well plates (Nunc) with a quantity of 1 ml of diet per well. The artificial diet was allowed to solidify by cooling at room temperature. Diet was stored at 4° C. for up to three weeks.

TABLE A

| Ingredients for Artificial diet | |
| --- | --- |
| Ingredients | Volume for 1 L |
| water | 768 ml |
| agar | 14 g |
| rolled oats | 40 g |
| Torula yeast | 60 g |
| lactalbumin hydrolysate | 30 g |
| casein | 10 g |
| fructose | 20 g |
| Wesson salt mixture | 4 g |
| tomato fruit powder | 12.5 g |
| potato leaf powder | 25 g |
| b-sitosterol | 1 g |
| sorbic acid | 0.8 g |
| methyl paraben | 0.8 g |
| Vanderzant vitamin mix | 12 g |
| neomycin sulfate | 0.2 g |
| aureomycin | 0.130 g |
| rifampicin | 0.130 g |
| chloramphenicol | 0.130 g |
| nystatin | 0.050 g |
| soybean oil | 2 ml |
| wheat germ oil | 2 ml |

Fifty µl of a solution of dsRNA at a concentration of 1 mg/ml was applied topically onto the solid artificial diet in the wells of the multiwell plate. The diet was dried in a laminair flow cabin. Per treatment, twenty-four Colorado potato beetle larvae ($2^{nd}$ stage), with two insects per well, were tested. The plates were stored in the insect rearing chamber at 25±2° C., 60% relative humidity, with a 16:8 hours light:dark photoperiod. The beetles were assessed as live or dead every 1, 2 or 3 days. After seven days, for targets LD006, LD007, LD010, LD011, and LD014, the diet was replaced with fresh diet with topically applied dsRNA at the same concentration (1 mg/ml); for targets LD001, LD002, LD003, LD015, and LD016, the diet was replaced with fresh diet only. The dsRNA targets were compared to diet only or diet with topically applied dsRNA corresponding to a fragment of the GFP (green fluorescent protein) coding sequence (SEQ ID NO 235).

Feeding artificial diet containing intact naked dsRNAs to *L. decemlineata* larvae resulted in significant increases in larval mortalities as indicated in two separate bioassays (FIGS. 1LD-2LD).

All dsRNAs tested resulted ultimately in 100% mortality after 7 to 14 days. Diet with or without GFP dsRNA sustained the insects throughout the bioassays with very little or no mortality.

Typically, in all assays observed, CPB second-stage larvae fed normally on diet with or without dsRNA for 2 days and molted to the third larval stage. At this new larval stage the CPB were observed to reduce significantly or stop altogether their feeding, with an increase in mortality as a result.

E. Bioassay of dsRNA Targets Using Potato Leaf Discs for Activity Against the *Leptinotarsa decemlineata*

An alternative bioassay method was employed using potato leaf material rather than artificial diet as food source for CPB. Discs of approximately 1.1 cm in diameter (or 0.95 $cm^2$) were cut out off leaves of 2 to 3-week old potato plants using a suitably-sized cork borer. Treated leaf discs were prepared by applying 20 µl of a 10 ng/µl solution of target LD002 dsRNA or control gfp dsRNA on the adaxial leaf surface. The leaf discs were allowed to dry and placed individually in 24 wells of a 24-well multiplate (Nunc). A single second-larval stage CPB was placed into each well, which was then covered with tissue paper and a multiwell plastic lid. The plate containing the insects and leaf discs were kept in an insect chamber at 28° C. with a photoperiod of 16 h light/8 h dark. The insects were allowed to feed on the leaf discs for 2 days after which the insects were transferred to a new plate containing fresh treated leaf discs. Thereafter, the insects were transferred to a plate containing untreated leaf discs every day until day 7. Insect mortality and weight scores were recorded.

Feeding potato leaf discs with surface-applied intact naked dsRNA of target LD002 to *L. decemlineata* larvae resulted in a significant increase in larval mortalities (i.e. at day 7 all insects were dead; 100% mortality) whereas control gfp dsRNA had no effect on CPB survival. Target LD002 dsRNA severely affected the growth of the larvae after 2 to 3 days whereas the larvae fed with gfp dsRNA at the same concentration developed as normal (FIG. 3-LD).

F. Screening Shorter Versions of dsRNAs Using Artificial Diet for Activity Against *Leptinotarsa decemlineata*

This example exemplifies the finding that shorter (60 or 100 bp) dsRNA fragments on their own or as concatemer constructs are sufficient in causing toxicity towards the Colorado potato beetle.

LD014, a target known to induce lethality in Colorado potato beetle, was selected for this example. This gene encodes a V-ATPase subunit E (SEQ ID NO 15).

A 100 base pair fragment, LD014_F1, at position 195-294 on SEQ ID NO 15 (SEQ ID NO 159) and a 60 base pair fragment, LD014_F2, at position 235-294 on SEQ ID NO 15 (SEQ ID NO 160) were further selected. See also Table 7-LD.

Two concatemers of 300 base pairs, LD014_C1 and LD014_C2, were designed (SEQ ID NO 161 and SEQ ID NO 162). LD014_C1 contained 3 repeats of the 100 base pair fragment described above (SEQ ID NO 159) and LD014_C2 contained 5 repeats of the 60 base pair fragment described above (SEQ ID NO 160). See also Table 7-LD.

The fragments LD014_F1 and LD014_F2 were synthesized as sense and antisense primers. These primers were annealed to create the double strands DNA molecules prior to cloning. XbaI and XmaI restrictions sites were included at the 5' and 3' ends of the primers, respectively, to facilitate the cloning.

The concatemers were made as 300 base pairs synthetic genes. XbaI and XmaI restrictions sites were included at the 5' and 3' ends of the synthetic DNA fragments, respectively, to facilite the cloning.

The 4 DNA molecules, i.e. the 2 single units (LD014_F1 & LD014_F2) and the 2 concatemers (LD014_C1 & LD014_C2), were digested with XbaI and XmaI and subcloned in pBluescriptII SK+ linearised by XbaI and XmaI digests, resulting in recombinant plasmids p1, p2, p3, & p4, respectively.

Double-stranded RNA production: dsRNA was synthesized using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter. For LD014_F1, the sense T7 template was generated using the specific T7 forward primer oGBM159 and the specific reverse primer oGBM164 (represented herein as SEQ ID NO 204 and SEQ ID NO 205, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific forward primer oGBM163 and the specific T7 reverse primer oGBM160 (represented herein as SEQ ID NO 206 and SEQ ID NO 207, respectively) in a PCR reaction with the same conditions as described above. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, Dnase and Rnase treated, and purified by sodium acetate, following the manufacturer's instructions. The sense strand of the resulting dsRNA is herein represented by SEQ ID NO 203.

For LD014_F2, the sense T7 template was generated using the specific T7 forward primer oGBM161 and the specific reverse primer oGBM166 (represented herein as SEQ ID NO 209 and SEQ ID NO 210, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific forward primer oGBM165 and the specific T7 reverse primer oGBM162 (represented herein as SEQ ID NO 211 and SEQ ID NO 212, respectively) in a PCR reaction with the same conditions as described above. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, Dnase and Rnase treated, and purified by sodium acetate, following the manufacturer's instructions. The sense strand of the resulting dsRNA is herein represented by SEQ ID NO 208.

Also for the concatemers, separate single 5' T7 RNA polymerase promoter templates were generated in two separate PCR reactions, each reaction containing the target sequence in a different orientation relative to the T7 promoter. The recombinant plasmids p3 and p4 containing LD014_C1 & LD014_02 were linearised with XbaI or XmaI, the two linear fragments for each construct purified and used as template for the in vitro transcription assay, using the T7 promoters flanking the cloning sites. Double-stranded RNA was prepared by in vitro transcription using the T7 RiboMAX™ Express RNAi System (Promega). The sense strands of the resulting dsRNA for LD014_C1 and LD014_C2 are herein represented by SEQ ID NO 213 and 2114, respectively.

Shorter sequences of target LD014 and concatemers were able to induce lethality in *Leptinotarsa decemlineata*, as shown in FIG. 4-LD.

G. Screening dsRNAs at Different Concentrations Using Artificial Diet for Activity Against *Leptinotarsa decemlineata*

Fifty µl of a solution of dsRNA at serial ten-fold concentrations from 1 µg/µl (for target LD027 from 0.1 µg/µl) down to 0.01 ng/µl was applied topically onto the solid artificial diet in the wells of a 24-well plate (Nunc). The diet was dried in a laminair flow cabin. Per treatment, twenty-four Colorado potato beetle larvae ($2^{nd}$ stage), with two insects per well, were tested. The plates were stored in the insect rearing chamber at 25±2° C., 60% relative humidity, with a 16:8 hours light:dark photoperiod. The beetles were assessed as live or dead at regular intervals up to day 14. After seven days, the diet was replaced with fresh diet with topically applied dsRNA at the same concentrations. The dsRNA targets were compared to diet only.

Feeding artificial diet containing intact naked dsRNAs of different targets to *L. decemlineata* larvae resulted in high larval mortalities at concentrations as low as between 0.1 and 10 ng dsRNA/µl as shown in FIG. 5-LD.

H. Adults are Extremely Susceptible to Orally Ingested dsRNA Corresponding to Target Genes.

The example provided below highlights the finding that adult insects (and not only insects of the larval stage) are extremely susceptible to orally ingested dsRNA corresponding to target genes.

Four targets were chosen for this experiment: targets 2, 10, 14 and 16 (SEQ ID NO 168, 188, 198 and 220, respectively). GFP fragment dsRNA (SEQ ID NO 235) was used as a control. Young adults (2 to 3 days old) were picked at random from our laboratory-reared culture with no bias towards insect gender. Ten adults were chosen per treatment. The adults were prestarved for at least 6 hours before the onset of the treatment. On the first day of treatment, each adult was fed four potato leaf discs (diameter 1.5 cm$^2$) which were pretreated with a topical application of 25 µl of 0.1 µg/µl target dsRNA (synthesized as described in Example 3A; topical application as described in Example 3E) per disc. Each adult was confined to a small petridish (diameter 3 cm) in order to make sure that all insects have ingested equal amounts of food and thus received equal doses of dsRNA. The following day, each adult was again fed four treated leaf discs as described above. On the third day, all ten adults per treatment were collected and placed together in a cage consisting of a plastic box (dimensions 30 cm×20 cm×15 cm) with a fine nylon mesh built into the lid to provide good aeration. Inside the box, some moistened filter paper was placed in the base. Some (untreated) potato foliage was placed on top of the paper to maintain the adults during the experiment. From day 5, regular assessments were carried out to count the number of dead, alive (mobile) and moribund insects. For insect moribundity, adults were laid on their backs to check whether they could right themselves within several minutes; an insect was considered moribund only if it was not able to turn onto its front.

Clear specific toxic effects of double-stranded RNA corresponding to different targets towards adults of the Colorado potato beetle, *Leptinotarsa decemlineata*, were demonstrated in this experiment (FIG. 6-LD). Double-stranded RNA corresponding to a gfp fragment showed no toxicity towards CPB adults on the day of the final assessment (day 19). This experiment clearly showed that the survival of CPB adults was severely reduced only after a few days of exposure to dsRNA when delivered orally. For example, for target 10, on day 5, 5 out of 10 adults were moribund (sick and slow moving); on day 6, 4 out of 10 adults were dead with three of the survivors moribund; on day 9 all adults were observed dead.

As a consequence of this experiment, the application of target double-stranded RNAs against insect pests may be broadened to include the two life stages of an insect pest (i.e. larvae and adults) which could cause extensive crop damage, as is the case with the Colorado potato beetle.

I. Laboratory Trials to Test Transgenic Potato Plants Against Larvae of the Colorado Potato Beetle, *Leptinotarsa decemlineata*

The example provided below is an exemplification of the finding that transgenic potato plants expressing CPB-gene-specific hairpin RNAs adversely affected Colorado potato beetles.

Potato Transformation

Stably transformed potato plants were obtained using an adapted protocol received through Julie Gilbert at the NSF Potato Genome Project. Stem internode explants of potato 'Line V' (obtained from the Laboratory of Plant Breeding at PRI Wageningen, the Netherlands) which was derived from the susceptible diploid *Solanum tuberosum* 6487-9 were used as starting material for transformation.

In vitro derived explants were inoculated with *Agrobacterium tumifaciens* C58C$_1$Rif$^R$ containing the hairpin constructs. After three days co-cultivation the explants were put onto a selective medium containing 100 mg/l Kanamycin and 300 mg/l Timentin. After 6 weeks post-transformation the first putative shoots were removed and rooted on selective medium. Shoots originating from different explants were treated as independent events, shoots originating from the same callus were termed 'siblings' until their clonal status can be verified by Southerns, and nodal cuttings of a shoot were referred to as 'clones'.

The transgenic status of the rooting shoots was checked either by GFP fluorescence or by plus/minus PCR for the target sequence. Positive shoots were then clonally propagated in tissue culture to ensure enough replicates were available for the Colorado potato beetle assay with the first plants being available to test fourteen weeks post transformation.

Bioassay

Transgenic potato plants were grown to the 8-12 unfolded leaf stage in a plant growth room chamber with the following conditions: 23±2° C., 60% relative humidity, 16:8 hour light:dark photoperiod. The plants were caged by placing a 500 ml bottle upside down over the plant with the neck of the bottle firmly placed in the soil in a pot and base cut open and covered with a fine nylon mesh to permit aeration, reduce condensation inside and prevent larval escape.

In this bioassay, seven neonate CPB larvae were placed on the foliage of each transgenic potato plant. Six transgenic potato siblings per transformation event (i.e. plants derived from one callus) of the hairpin construct LD002 (comprising SEQ ID NO 240) (labeled as pGBNB001/28A to F) and empty vector (labeled as pK7GWIWG2D(II)/11A to F), and two wild type plants were tested. Temperature, humidity and lighting conditions were the same as described above. At day 7 (7 days after the start of the bioassay), the number of survivors were counted and the average weight of larval survivors from each plant recorded. Data was analysed using the Spotfire® DecisionSite® 9.0 software (Version 17.1.779) from Spotfire Inc.

In this experiment, all larvae of the Colorado potato beetle on two sibling plants (labeled as pGBNB001/28A and pGBNB001/28F), harbouring hairpin construct LD002, generated from a single transformation event, were dead on day 7 (FIG. 7-LD). Feeding damage by CPB larvae on these two plants was very low when compared to the empty vector transgenic plants or wild type line V plants.

Example 4

*Phaedon cochleariae* (Mustard Leaf Beetle)

A. Cloning of a Partial Sequence of the *Phaedon cochleariae* (Mustard Leaf Beetle) PC001, PC003, PC005, PC010, PC014, PC016 and PC027 Genes Via Family PCR High quality, intact RNA was isolated from the third larval stage of *Phaedon cochleariae* (mustard leaf beetle; source: Dr. Caroline Muller, Julius-von-Sachs-Institute for Biosciences, Chemical Ecology Group, University of Wuerzburg, Julius-von-Sachs-Platz 3, D-97082 Wuerzburg, Germany) using TRIzol Reagent (Cat. Nr. 15596-026/15596-018, Invitrogen, Rockville, Md., USA) following the manufacturer's instructions. Genomic DNA present in the RNA preparation was removed by DNase (Cat. Nr. 1700, Promega) treatment following the manufacturers instructions. cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the PC001, PC003, PC005, PC010, PC014, PC016 and PC027 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-PC. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K4530-20, Invitrogen) and sequenced. The sequences of the resulting PCR products are represented by the respective SEQ ID NOs as given in Table 2-PC and are referred to as the partial sequences.

The corresponding partial amino acid sequence are represented by the respective SEQ ID NOs as given in Table 3-PC. Table 3-PC provides amino acid sequences of cDNA clones, and the start of the reading frame is indicated in brackets.

B. dsRNA Production of the *Phaedon cochleariae* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-PC. Table 8-PC provides details for preparing ds RNA fragments of *Phaedon cochleariae* target sequences, including primer sequences.

The conditions in the PCR reactions were as follows: 1 minute at 95° C., followed by 20 cycles of 30 seconds at 95° C., 30 seconds at 60° C. and 1 minute at 72° C., followed by 15 cycles of 30 seconds at 95° C., 30 seconds at 50° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-PC. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-PC.

C. Recombination of the *Phaedon cochleariae* (Mustard Leaf Beetle) Genes into the Plant Vector pK7GWIWG2D(II)

Since the mechanism of RNA interference operates through dsRNA fragments, the target nucleotide sequences of the target genes, as selected above, were cloned in anti-sense and sense orientation, separated by the intron—CmR-intron, whereby CmR is the chloramphenicol resistance marker, to form a dsRNA hairpin construct. These hairpin constructs were generated using the LR recombination reaction between an attL-containing entry clone (see Example 4A) and an attR-containing destination vector (=pK7GWIWG2D(II)). The plant vector pK7GWIWG2D(II) was obtained from the VIB/Plant Systems Biology with a Material Transfer Agreement. LR recombination reaction was performed by using LR Clonase™ II enzyme mix (Cat. Nr. 11791-020, Invitrogen) following the manufacturer's instructions. These cloning experiments resulted in a hairpin construct for each of the PC001, PC010, PC014, PC016 and PC027 genes, having the promoter—sense-intron-CmR-intron-antisense orientation, and wherein the promoter is the plant operable 35S promoter. The binary vector pK7GWIWG2D(II) with the 35S promoter is suitable for transformation into *A. tumefaciens*.

Restriction enzyme digests were carried out on pCR8/GW/TOPO plasmids containing the different targets (see Example 4B): for PC001, a double digest with BsoBI & PvuI; for PC010, a double digest with PvuI & PvuII; for PC014, a triple digest with HincII, PvuI & XhoI; for PC016, a single digest with ApaLI; for PC027, a double digest with AvaI & DrdI. The band containing the gene of interest flanked by the attL sites using Qiaquick Gel Extraction Kit (Cat. Nr. 28706, Qiagen) was purified. An amount of 150 ng of purified fragment and 150 ng pK7GWIWG2D(II) was added together with the LR clonase II enzyme and incubated for at least 1 h at 25° C. After proteinase K solution treatment (10 min at 37° C.), the whole recombination mix was transformed into Top 10 chemically competent cells. Positive clones were selected by restriction digest analyses. The complete sequence of the hairpin construct for:

- PC001 (sense-intron-CmR-intron-antisense) is represented in SEQ ID NO 508;
- PC010 (sense-intron-CmR-intron-antisense) is represented in SEQ ID NO 509;
- PC014 (sense-intron-CmR-intron-antisense) is represented in SEQ ID NO 510;
- PC016 (sense-intron-CmR-intron-antisense) is represented in SEQ ID NO 511;
- PC027 (sense-intron-CmR-intron-antisense) is represented in SEQ ID NO 512;

Table 9-PC provides sequences for each hairpin construct.

D. Laboratory Trials to Test dsRNA Targets, Using Oilseed Rape Leaf Discs for Activity Against *Phaedon cochleariae* Larvae The example provided below is an exemplification of the finding that the mustard leaf beetle (MLB) larvae are susceptible to orally ingested dsRNA corresponding to own target genes.

To test the different double-stranded RNA samples against MLB larvae, a leaf disc assay was employed using oilseed rape (*Brassica napus* variety SW Oban; source: Nick Balaam, Sw Seed Ltd., 49 North Road, Abington, Cambridge, CB1 6AS, UK) leaf material as food source. The insect cultures were maintained on the same variety of oilseed rape in the insect chamber at 25±2° C. and 60±5% relative humidity with a photoperiod of 16 h light/8 h dark. Discs of approximately 1.1 cm in diameter (or 0.95 $cm^2$) were cut out off leaves of 4- to 6-week old rape plants using a suitably-sized cork borer. Double-stranded RNA samples were diluted to 0.1 μg/μl in Milli-Q water containing 0.05% Triton X-100. Treated leaf discs were prepared by applying 25 μl of the diluted solution of target PC001, PC003, PC005, PC010, PC014, PC016, PC027 dsRNA and control gfp dsRNA or 0.05% Triton X-100 on the adaxial leaf surface. The leaf discs were left to dry and placed individually in each of the 24 wells of a 24-well multiplate containing 1 ml of gellified 2% agar which helps to prevent the leaf disc from drying out. Two neonate MLB larvae were placed into each well of the plate, which was then covered with a multiwell plastic lid. The plate (one treatment containing 48 insects) was divided into 4 replicates of 12 insects per replicate (each row). The plate containing the insects and leaf discs were kept in an insect chamber at 25±2° C. and 60±5% relative humidity with a photoperiod of 16 h light/8 h dark. The insects were fed leaf discs for 2 days after which they were transferred to a new plate containing freshly treated leaf discs. Thereafter, 4 days after the start of the bioassay, the insects from each replicate were collected and transferred to a Petri dish containing untreated fresh oilseed rape leaves. Larval mortality and average weight were recorded at days 2, 4 7, 9 and 11.

*P. cochleariae* larvae fed on intact naked target dsRNA-treated oilseed rape leaves resulted in significant increases in larval mortalities for all targets tested, as indicated in FIG. 1(a). Tested double-stranded RNA for target PC010 led to 100% larval mortality at day 9 and for target PC027 at day 11. For all other targets, significantly high mortality values were reached at day 11 when compared to control gfp dsRNA, 0.05% Trition X-100 alone or untreated leaf only: (average value in percentage±confidence interval with alpha 0.05) PC001 (94.4±8.2); PC003 (86.1±4.1); PC005 (83.3±7.8); PC014 (63.9±20.6); PC016 (75.0±16.8); gfp dsRNA (11.1±8.2); 0.05% Triton X-100 (19.4±10.5); leaf only (8.3±10.5).

Larval survivors were assessed based on their average weight. For all targets tested, the mustard leaf beetle larvae had significantly reduced average weights after day 4 of the bioassay; insects fed control gfp dsRNA or 0.05% Triton X-100 alone developed normally, as for the larvae on leaf only (FIG. 1(b)-PC).

E. Laboratory Trials to Screen dsRNAs at Different Concentrations Using Oilseed Rape Leaf Discs for Activity Against *Phaedon cochleariae* Larvae Twenty-five µl of a solution of dsRNA from target PC010 or PC027 at serial ten-fold concentrations from 0.1 µg/µl down to 0.1 ng/µl was applied topically onto the oilseed rape leaf disc, as described in Example 4D above. As a negative control, 0.05% Triton X-100 only was administered to the leaf disc. Per treatment, twenty-four mustard leaf beetle neonate larvae, with two insects per well, were tested. The plates were stored in the insect rearing chamber at 25±2° C., 60±5% relative humidity, with a 16:8 hours light:dark photoperiod. At day 2, the larvae were transferred on to a new plate containing fresh dsRNA-treated leaf discs. At day 4 for target PC010 and day 5 for target PC027, insects from each replicate were transferred to a Petri dish containing abundant untreated leaf material. The beetles were assessed as live or dead on days 2, 4, 7, 8, 9, and 11 for target PC010, and 2, 5, 8, 9 and 12 for target PC027.

Feeding oilseed rape leaf discs containing intact naked dsRNAs of the two different targets, PC010 and PC027, to *P. cochleariae* larvae resulted in high mortalities at concentrations down to as low as 1 ng dsRNA/µl solution, as shown in FIGS. 2 (*a*) and (*b*). Average mortality values in percentage±confidence interval with alpha 0.05 for different concentrations of dsRNA for target PC010 at day 11, 0 µg/µl: 8.3±9.4; 0.1 µg/µl: 100; 0.01 µg/µl: 79.2±20.6; 0.001 µg/µl: 58.3±9.4; 0.0001 µg/µl: 12.5±15.6; and for target PC027 at day 12, 0 µg/µl: 8.3±9.4; 0.1 µg/µl: 95.8±8.2; 0.01 µg/µl: 95.8±8.2; 0.001 µg/µl: 83.3±13.3; 0.0001 µg/µl: 12.5±8.2.

F. Laboratory Trials of *Myzus periscae* (Green Peach Aphid) Infestation on Transgenic *Arabidopsis thaliana* Plants Generation of Transgenic Plants

*Arabidopsis thaliana* plants were transformed using the floral dip method (Clough and Bent (1998) *Plant Journal* 16:735-743). Aerial parts of the plants were incubated for a few seconds in a solution containing 5% sucrose, resuspended *Agrobacterium tumefaciens* strain C58C1 Rif cells from an overnight culture and 0.03% of the surfactant Silwet L-77. After inoculation, plants were covered for 16 hours with a transparent plastic to maintain humidity. To increase the transformation efficiency, the procedure was repeated after one week. Watering was stopped as seeds matured and dry seeds were harvested and cold-treated for two days. After sterilization, seeds were plated on a kanamycin-containing growth medium for selection of transformed plants.

The selected plants are transferred to soil for optimal T2 seed production.

Bioassay

Transgenic *Arabidopsis thaliana* plants are selected by allowing the segregating T2 seeds to germinate on appropriate selection medium. When the roots of these transgenics are well-established they are then transferred to fresh artificial growth medium or soil and allowed to grow under optimal conditions. Whole transgenic plants are tested against nymphs of the green peach aphid (*Myzus persicae*) to show (1) a significant resistance to plant damage by the feeding nymph, (2) increased nymphal mortality, and/or (3) decreased weight of nymphal survivors (or any other aberrant insect development).

Example 5

*Epilachna varivetis* (Mexican Bean Beetle)

A. Cloning *Epilachna varivetis* Partial Gene Sequences

High quality, intact RNA was isolated from 4 different larval stages of *Epilachna varivetis* (Mexican bean beetle; source: Thomas Dorsey, Supervising Entomologist, New Jersey Department of Agriculture, Division of Plant Industry, Bureau of Biological Pest Control, Phillip Alampi Beneficial Insect Laboratory, PO Box 330, Trenton, N.J. 08625-0330, USA) using TRIzol Reagent (Cat. Nr. 15596-026/ 15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the EV005, EV009, EV010, EV015 and EV016 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-EV, which displays *Epilachna varivetis* target genes including primer sequences and cDNA sequences obtained. These primers were used in respective PCR reactions with the following conditions: for EV005 and EV009, 10 minutes at 95° C., followed by 40 cycles of 30 seconds at 95° C., 1 minute at 50° C. and 1 minute 30 seconds at 72° C., followed by 7 minutes at 72° C.; for EV014, 10 minutes at 95° C., followed by 40 cycles of 30 seconds at 95° C., 1 minute at 53° C. and 1 minute at 72° C., followed by 7 minutes at 72° C.; for EV010 and EV016, 10 minutes at 95° C., followed by 40 cycles of 30 seconds at 95° C., 1 minute at 54° C. and 1 minute 40 seconds at 72° C., followed by 7 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K4530-20, Invitrogen), and sequenced. The sequences of the resulting PCR products are represented by the respective SEQ ID NOs as given in Table 2-EV and are referred to as the partial sequences. The corresponding partial amino acid sequences are represented by the respective SEQ ID NOs as given in Table 3-EV, where the start of the reading frame is indicated in brackets.

B. dsRNA Production of the *Epilachna varivetis* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-EV.

The conditions in the PCR reactions were as follows: 1 minute at 95° C., followed by 20 cycles of 30 seconds at 95° C., 30 seconds at 60° C. and 1 minute at 72° C., followed by 15 cycles of 30 seconds at 95° C., 30 seconds at 50° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-EV. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-EV.

C. Recombination of the *Epilachna varivetis* Genes into the Plant Vector pK7GWIWG2D(II)

Since the mechanism of RNA interference operates through dsRNA fragments, the target nucleotide sequences of the target genes, as selected above, are cloned in anti-sense and sense orientation, separated by the intron—CmR-intron, whereby CmR is the chloramphenicol resistance marker, to form a dsRNA hairpin construct. These hairpin constructs are generated using the LR recombination reaction between an attL-containing entry clone (see Example 5A) and an attR-containing destination vector (=pK7GWIWG2D(II)). The plant vector pK7GWIWG2D (II) is obtained from the VIB/Plant Systems Biology with a Material Transfer Agreement. LR recombination reaction is performed by using LR Clonase™ II enzyme mix (Cat. Nr. 11791-020, Invitrogen) following the manufacturer's instructions. These cloning experiments result in a hairpin construct for each of the target genes, having the promoter—sense-intron-CmR-intron-antisense orientation, and wherein the promoter is the plant operable 35S promoter. The binary vector pK7GWIWG2D(II) with the 35S promoter is suitable for transformation into *A. tumefaciens*.

Restriction enzyme digests were carried out on pCR8/GW/TOPO plasmids containing the different targets (see Example B). The band containing the gene of interest flanked by the attL sites using Qiaquick Gel Extraction Kit (Cat. Nr. 28706, Qiagen) is purified. An amount of 150 ng of purified fragment and 150 ng pK7GWIWG2D(II) is added together with the LR clonase II enzyme and incubated for at least 1 h at 25° C. After proteinase K solution treatment (10 min at 37° C.), the whole recombination mix is transformed into Top 10 chemically competent cells. Positive clones are selected by restriction digest analyses.

D. Laboratory Trials to Test dsRNA Targets Using Bean Leaf Discs for Activity Against *Epilachna varivetis* Larvae The example provided below is an exemplification of the finding that the Mexican bean beetle (MBB) larvae are susceptible to orally ingested dsRNA corresponding to own target genes.

To test the different double-stranded RNA samples against MBB larvae, a leaf disc assay was employed using snap bean (*Phaseolus vulgaris* variety Montano; source: Aveve N V, Belgium) leaf material as food source. The same variety of beans was used to maintain insect cultures in the insect chamber at 25±2° C. and 60±5% relative humidity with a photoperiod of 16 h light/8 h dark. Discs of approximately 1.1 cm in diameter (or 0.95 $cm^2$) were cut out off leaves of 1- to 2-week old bean plants using a suitably-sized cork borer. Double-stranded RNA samples were diluted to 1 μg/μl in Milli-Q water containing 0.05% Triton X-100. Treated leaf discs were prepared by applying 25 μl of the diluted solution of target Ev005, Ev010, Ev015, Ev016 dsRNA and control gfp dsRNA or 0.05% Triton X-100 on the adaxial leaf surface. The leaf discs were left to dry and placed individually in each of the 24 wells of a 24-well multiplate containing 1 ml of gellified 2% agar which helps to prevent the leaf disc from drying out. A single neonate MBB larva was placed into each well of a plate, which was then covered with a multiwell plastic lid. The plate was divided into 3 replicates of 8 insects per replicate (row). The plate containing the insects and leaf discs were kept in an insect chamber at 25±2° C. and 60±5% relative humidity with a photoperiod of 16 h light/8 h dark. The insects were fed on the leaf discs for 2 days after which the insects were transferred to a new plate containing freshly treated leaf discs. Thereafter, 4 days after the start of the bioassay, the insects were transferred to a petriplate containing untreated fresh bean leaves every day until day 10. Insect mortality was recorded at day 2 and every other day thereafter.

Feeding snap bean leaves containing surface-applied intact naked target dsRNAs to *E. varivestis* larvae resulted in significant increases in larval mortalities, as indicated in FIG. 1. Tested double-stranded RNAs of targets Ev010, Ev015, & Ev016 led to 100% mortality after 8 days, whereas dsRNA of target Ev005 took 10 days to kill all larvae. The majority of the insects fed on treated leaf discs containing control gfp dsRNA or only the surfactant Triton X-100 were sustained throughout the bioassay (FIG. 1-EV).

E. Laboratory Trials to Test dsRNA Targets Using Bean Leaf Discs for Activity Against *Epilachna varivestis* Adults The example provided below is an exemplification of the finding that the Mexican bean beetle adults are susceptible to orally ingested dsRNA corresponding to own target genes.

In a similar bioassay set-up as for Mexican bean beetle larvae, adult MBBs were tested against double-stranded RNAs topically-applied to bean leaf discs. Test dsRNA from each target Ev010, Ev015 and Ev016 was diluted in 0.05%

Triton X-100 to a final concentration of 0.1 µg/µl. Bean leaf discs were treated by topical application of 30 µl of the test solution onto each disc. The discs were allowed to dry completely before placing each on a slice of gellified 2% agar in each well of a 24-well multiwell plate. Three-day-old adults were collected from the culture cages and fed nothing for 7-8 hours prior to placing one adult to each well of the bioassay plate (thus 24 adults per treatment). The plates were kept in the insect rearing chamber (under the same conditions as for MBB larvae for 24 hours) after which the adults were transferred to a new plate containing fresh dsRNA-treated leaf discs. After a further 24 hours, the adults from each treatment were collected and placed in a plastic box with dimensions 30 cm×15 cm×10 cm containing two potted and untreated 3-week-old bean plants. Insect mortality was assessed from day 4 until day 11.

All three target dsRNAs (Ev010, Ev015 and Ev016) ingested by adults of Epilachna varivestis resulted in significant increases in mortality from day 4 (4 days post bioassay start), as shown in FIG. 2-EV(a). From day 5, dramatic changes in feeding patterns were observed between insects fed initially with target-dsRNA-treated bean leaf discs and those that were fed discs containing control gfp dsRNA or surfactant Triton X-100. Reductions in foliar damage by MBB adults of untreated bean plants were clearly visible for all three targets when compared to gfp dsRNA and surfactant only controls, albeit at varying levels; insects fed target 15 caused the least damage to bean foliage (FIG. 2-EV(b)).

Example 6

*Anthonomus grandis* (Cotton Boll Weevil)

A. Cloning *Anthonomus grandis* Partial Sequences

High quality, intact RNA was isolated from the 3 instars of *Anthonomus grandis* (cotton boll weevil; source: Dr. Gary Benzon, Benzon Research Inc., 7 Kuhn Drive, Carlisle, Pa. 17013, USA) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manafacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the AG001, AG005, AG010, AG014 and AG016 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-AG. These primers were used in respective PCR reactions with the following conditions: for AG001, AG005 and AG016, 10 minutes at 95° C., followed by 40 cycles of 30 seconds at 95° C., 1 minute at 50° C. and 1 minute and 30 seconds at 72° C., followed by 7 minutes at 72° C.; for AG010, 10 minutes at 95° C., followed by 40 cycles of 30 seconds at 95° C., 1 minute at 54° C. and 2 minutes and 30 seconds at 72° C., followed by 7 minutes at 72° C.; for AG014, 10 minutes at 95° C., followed by 40 cycles of 30 seconds at 95° C., 1 minute at 55° C. and 1 minute at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen) and sequenced. The sequences of the resulting PCR products are represented by the respective SEQ ID NOs as given in Table 2-AG and are referred to as the partial sequences. The corresponding partial amino acid sequence are represented by the respective SEQ ID NOs as given in Table 3-AG.

B. dsRNA Production of the *Anthonomus grandis* (Cotton Boll Weevil) Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-AG. A touchdown PCR was performed as follows: 1 minute at 95° C., followed by 20 cycles of 30 seconds at 95° C., 30 seconds at 60° C. with a decrease in temperature of 0.5° C. per cycle and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-AG. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-AG.

C. Recombination of *Anthonomus grandis* Genes into the Plant Vector pK7GWIWG2D(II)

Since the mechanism of RNA interference operates through dsRNA fragments, the target nucleotide sequences of the target genes, as selected above, are cloned in anti-sense and sense orientation, separated by the intron—CmR-intron, whereby CmR is the chloramphenicol resistance marker, to form a dsRNA hairpin construct. These hairpin constructs are generated using the LR recombination reaction between an attL-containing entry clone (see Example 6A) and an attR-containing destination vector (=pK7GWIWG2D(II)). The plant vector pK7GWIWG2D(II) is obtained from the VIB/Plant Systems Biology with a Material Transfer Agreement. LR recombination reaction is performed by using LR Clonase™ II enzyme mix (Cat. Nr. 11791-020, Invitrogen) following the manufacturer's instructions. These cloning experiments result in a hairpin construct for each of the target genes, having the promoter—sense-intron-CmR-intron-antisense orientation, and wherein the promoter is the plant operable 35S promoter. The binary vector pK7GWIWG2D(II) with the 35S promoter is suitable for transformation into *A. tumefaciens.*

Restriction enzyme digests were carried out on pCR8/GW/TOPO plasmids containing the different targets (see Example 6B). The band containing the gene of interest flanked by the attL sites using Qiaquick Gel Extraction Kit (Cat. Nr. 28706, Qiagen) is purified. An amount of 150 ng of purified fragment and 150 ng pK7GWIWG2D(II) is added together with the LR clonase II enzyme and incubated for at least 1 h at 25° C. After proteinase K solution treatment (10 min at 37° C.), the whole recombination mix is transformed into Top 10 chemically competent cells. Positive clones are selected by restriction digest analyses.

D. Laboratory Trials to Test *Escherichia coli* Expressing dsRNA Targets Against *Anthonomus grandis*

Plant-Based Bioassays

Whole plants are sprayed with suspensions of chemically induced bacteria expressing dsRNA prior to feeding the plants to CBW. The are grown from in a plant growth room chamber. The plants are caged by placing a 500 ml plastic bottle upside down over the plant with the neck of the bottle firmly placed in the soil in a pot and the base cut open and covered with a fine nylon mesh to permit aeration, reduce condensation inside and prevent insect escape. CBW are placed on each treated plant in the cage. Plants are treated with a suspension of *E. coli* AB301-105(DE3) harboring the pGXXX0XX plasmids or pGN29 plasmid. Different quantities of bacteria are applied to the plants: for instance 66, 22, and 7 units, where one unit is defined as $10^9$ bacterial cells in 1 ml of a bacterial suspension at optical density value of 1 at 600 nm wavelength. In each case, a total volume of between 1 and 10 ml s sprayed on the plant with the aid of a vaporizer. One plant is used per treatment in this trial. The number of survivors are counted and the weight of each survivor recorded.

Spraying plants with a suspension of *E. coli* bacterial strain AB301-105(DE3) expressing target dsRNA from pGXXX0XX lead to a dramatic increase in insect mortality when compared to pGN29 control. These experiments show that double-stranded RNA corresponding to an insect gene target sequence produced in either wild-type or RNaseIII-deficient bacterial expression systems is toxic towards the insect in terms of substantial increases in insect mortality and growth/development delay for larval survivors. It is also clear from these experiments that an exemplification is provided for the effective protection of plants/crops from insect damage by the use of a spray of a formulation consisting of bacteria expressing double-stranded RNA corresponding to an insect gene target.

Example 7

*Tribolium castaneum* (Red Flour Beetle)

A. Cloning *Tribolium castaneum* Partial Sequences

High quality, intact RNA was isolated from all the different insect stages of *Tribolium castaneum* (red flour beetle; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the TC001, TC002, TC010, TC014 and TC015 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-TC. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. (TC001, TC014, TC015); 10 minutes at 95° C., followed by 40 cycles of 30 seconds at 95° C., 1 minute at 54° C. and 2 minutes and 30 seconds at 72° C., followed by 7 minutes at 72° C. (TC010); 10 minutes at 95° C., followed by 40 cycles of 30 seconds at 95° C., 1 minute at 53° C. and 1 minute at 72° C., followed by 7 minutes at 72° C. (TC002). The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen), and sequenced. The sequences of the resulting PCR products are represented by the respective SEQ ID NOs as given in Table 2-TC and are referred to as the partial sequences. The corresponding partial amino acid sequences are represented by the respective SEQ ID NOs as given in Table 3-TC.

B. dsRNA Production of the *Tribolium castaneum* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-TC. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-TC. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-TC.

C. Recombination of *Tribolium castaneum* Genes into the Plant Vector pK7GWIWG2D(II)

Since the mechanism of RNA interference operates through dsRNA fragments, the target nucleotide sequences of the target genes, as selected above, are cloned in anti-sense and sense orientation, separated by the intron—CmR-intron, whereby CmR is the chloramphenicol resistance marker, to form a dsRNA hairpin construct. These hairpin constructs are generated using the LR recombination reaction between an attL-containing entry clone (see Example 7A) and an attR-containing destination vector (=pK7GWIWG2D(II)). The plant vector pK7GWIWG2D (II) is obtained from the VIB/Plant Systems Biology with a Material Transfer Agreement. LR recombination reaction is performed by using LR Clonase™ II enzyme mix (Cat. Nr. 11791-020, Invitrogen) following the manufacturer's instructions. These cloning experiments result in a hairpin construct for each of the target genes, having the promoter—sense-intron-CmR-intron-antisense orientation, and wherein the promoter is the plant operable 35S promoter. The binary vector pK7GWIWG2D(II) with the 35S promoter is suitable for transformation into *A. tumefaciens*.

Restriction enzyme digests were carried out on pCR8/GW/TOPO plasmids containing the different targets (see Example 7B). The band containing the gene of interest flanked by the attL sites using Qiaquick Gel Extraction Kit (Cat. Nr. 28706, Qiagen) is purified. An amount of 150 ng of purified fragment and 150 ng pK7GWIWG2D(II) is added together with the LR clonase II enzyme and incubated for at least 1 h at 25° C. After proteinase K solution treatment (10 min at 37° C.), the whole recombination mix is transformed into Top 10 chemically competent cells. Positive clones are selected by restriction digest analyses.

D. Laboratory Trials to Test dsRNA Targets, Using Artificial Diet for Activity Against *Tribolium castaneum* Larvae The example provided below is an exemplification of the finding that the red flour beetle (RFB) larvae are susceptible to orally ingested dsRNA corresponding to own target genes.

Red flour beetles, *Tribolium castaneum*, were maintained at Insect Investigations Ltd. (origin: Imperial College of Science, Technology and Medicine, Silwood Park, Berkshire, UK). Insects were cultured according to company SOP/251/01. Briefly, the beetles were housed in plastic jars or tanks. These have an open top to allow ventilation. A piece of netting was fitted over the top and secured with an elastic band to prevent escape. The larval rearing medium (flour) was placed in the container where the beetles can breed. The stored product beetle colonies were maintained in a controlled temperature room at 25±3° C. with a 16:8 hour light:dark cycle.

Double-stranded RNA from target TC014 (with sequence corresponding to SEQ ID NO—799) was incorporated into a mixture of flour and milk powder (wholemeal flour:powdered milk in the ratio 4:1) and left to dry overnight. Each replicate was prepared separately: 100 μl of a 10 μg/μl dsRNA solution (1 mg dsRNA) was added to 0.1 g flour/milk mixture. The dried mixture was ground to a fine powder. Insects were maintained within Petri dishes (55 mm diameter), lined with a double layer of filter paper. The treated diet was placed between the two filter paper layers. Ten first instar, mixed sex larvae were placed in each dish (replicate). Four replicates were performed for each treatment. Control was Milli-Q water. Assessments (number of survivors) were made on a regular basis. During the trial, the test conditions were 25-33° C. and 20-25% relative humidity, with a 12:12 hour light:dark photoperiod.

Survival of larvae of *T. castaneum* over time on artificial diet treated with target TC014 dsRNA was significantly reduced when compared to diet only control, as shown in FIG. 1-TC.

Example 8

*Myzus persicae* (Green Peach Aphid)

A. Cloning *Myzus persicae* Partial Sequences

High quality, intact RNA was isolated from nymphs of *Myzus persicae* (green peach aphid; source: Dr. Rachel Down, Insect & Pathogen Interactions, Central Science Laboratory, Sand Hutton, York, YO41 1LZ, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the MP001, MP002, MP010, MP016 and MP027 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-MP. These primers were used in respective PCR reactions with the following conditions: for MP001, MP002 and MP016, 10 minutes at 95° C., followed by 40 cycles of 30 seconds at 95° C., 1 minute at 50° C. and 1 minute 30 seconds at 72° C., followed by 7 minutes at 72° C.; for MP027, a touchdown program was used: 10 minutes at 95° C., followed by 10 cycles of 30 seconds at 95° C., 40 seconds at 60° C. with a decrease in temperature of 1° C. per cycle and 1 minute 10 seconds at 72° C., followed by 30 cycles of 30 seconds at 95° C., 40 seconds at 50° C. and 1 minute 10 seconds at 72° C., followed by 7 minutes at 72° C.; for MP010, 10 minutes at 95° C., followed by 40 cycles of 30 seconds at 95° C., 1 minute at 54° C. and 3 minutes at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen), and sequenced. The sequences of the resulting PCR products are represented by the respective SEQ ID NOs as given in Table 2-MP and are referred to as the partial sequences. The corresponding partial amino acid sequences are represented by the respective SEQ ID NOs as given in Table 3-MP.

B. dsRNA Production of *Myzus persicae* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-MP. A touchdown PCR was performed as follows: 1 minute at 95° C., followed by 20 cycles of 30 seconds at 95° C., 30 seconds at 55° C. (for MP001, MP002, MP016, MP027 and gfp) or 30 seconds at 50° C. (for MP010) with a decrease in temperature of 0.5° C. per cycle and 1 minute at 72° C., followed by 15 cycles of 30 seconds at 95° C., 30 seconds at 45° C. and 1 minute at 72° C. followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-MP. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-MP.

C. Recombination of *Myzus persicae* Genes into the Plant Vector pK7GWIWG2D(II)

Since the mechanism of RNA interference operates through dsRNA fragments, the target nucleotide sequences of the target genes, as selected above, were cloned in anti-sense and sense orientation, separated by the intron— CmR-intron, whereby CmR is the chloramphenicol resistance marker, to form a dsRNA hairpin construct. These hairpin constructs were generated using the LR recombination reaction between an attL-containing entry clone (see Example 8A) and an attR-containing destination vector (=pK7GWIWG2D(II)). The plant vector pK7GWIWG2D (II) was obtained from the VIB/Plant Systems Biology with a Material Transfer Agreement. LR recombination reaction was performed by using LR Clonase™ II enzyme mix (Cat. Nr. 11791-020, Invitrogen) following the manufacturer's instructions. These cloning experiments resulted in a hairpin construct for each of the MP001, MP002, MP010, MP016 and MP026 genes, having the promoter—sense-intron-CmR-intron-antisense orientation and wherein the promoter is the plant operable 35S promoter. The binary vector pK7GWIWG2D(II) with the 35S promoter is suitable for transformation into *A. tumefaciens.*

A digest with restriction enzyme Alw441 was done for all the targets cloned into pCR8/GW/topo (see Example 8B). The band containing the gene of interest flanked by the attL sites using Qiaquick Gel Extraction Kit (Cat. Nr. 28706, Qiagen) was purified. An amount of 150 ng of purified fragment and 150 ng pK7GWIWG2D(II) was added together with the LR clonase II enzyme and incubated for at least 1 h at 25° C. After proteinase K solution treatment (10 min at 37° C.), the whole recombination mix was transformed into Top 10 chemically competent cells. Positive clones were selected by restriction digest analysis. The complete sequence of the hairpin construct for:

- MP001 (sense-intron-CmR-intron-antisense) is represented in SEQ ID NO 1066;
- MP002 (sense-intron-CmR-intron-antisense) is represented in SEQ ID NO 1067;
- MP010 (sense-intron-CmR-intron-antisense) is represented in SEQ ID NO 1068;
- MP016 (sense-intron-CmR-intron-antisense) is represented in SEQ ID NO 1069;
- MP027 (sense-intron-CmR-intron-antisense) is represented in SEQ ID NO 1070.

Table 9-MP provides complete sequences for each hairpin construct.

D. Laboratory Trials to Test dsRNA Targets Using Liquid Artificial Diet for Activity Against *Myzus persicae*

Liquid artificial diet for the green peach aphid, *Myzus persicae*, was prepared based on the diet suitable for pea aphids (*Acyrthosiphon pisum*), as described by Febvay et al. (1988) [Influence of the amino acid balance on the improvement of an artificial diet for a biotype of *Acyrthosiphon pisum* (Homoptera: Aphididae). Can. J. Zool. 66: 2449-2453], but with some modifications. The amino acids component of the diet was prepared as follows: in mg/100 ml, alanine 178.71, beta-alanine 6.22, arginine 244.9, asparagine 298.55, aspartic acid 88.25, cysteine 29.59, glutamic acid 149.36, glutamine 445.61, glycine 166.56, histidine 136.02, isoleucine 164.75, leucine 231.56, lysine hydrochloride 351.09, methionine 72.35, ornithine (HCl) 9.41, phenylalanine 293, proline 129.33, serine 124.28, threonine 127.16, tryptophane 42.75, tyrosine 38.63, L-valine 190.85. The amino acids were dissolved in 30 ml Milli-Q $H_2O$ except for tyrosine which was first dissolved in a few drops of 1 M HCl before adding to the amino acid mix. The vitamin mix component of the diet was prepared as a 5× concentrate stock as follows: in mg/L, amino benzoic acid 100, ascorbic acid 1000, biotin 1, calcium panthothenate 50, choline chloride 500, folic acid 10, myoinositol 420, nicotinic acid 100, pyridoxine hydrochloride 25, riboflavin 5, thiamine hydrochloride 25. The riboflavin was dissolved in 1 ml $H_2O$ at 50° C. and then added to the vitamin mix stock. The vitamin mix was aliquoted in 20 ml per aliquot and stored at −20° C. One aliquot of vitamin mix was added to the amino acid solution. Sucrose and $MgSO_4.7H_2O$ was added with the following amounts to the mix: 20 g and 242 mg, respectively. Trace metal stock solution was prepared as follows: in mg/100 ml, $CuSO_4.5H_2O$ 4.7, $FeCl_3.6H_2O$ 44.5, $MnCl_2$.4H2O 6.5, NaCl 25.4, $ZnCl_2$ 8.3. Ten ml of the trace metal solution and 250 mg $KH_2PO_4$ was added to the diet and Milli-Q water was added to a final liquid diet volume of 100 ml. The pH of the diet was adjusted to 7 with 1 M KOH solution. The liquid diet was filter-sterilised through an 0.22 μm filter disc (Millipore).

Green peach aphids (*Myzus persicae*; source: Dr. Rachel Down, Insect & Pathogen Interactions, Central Science Laboratory, Sand Hutton, York, YO41 1LZ, UK) were reared on 4- to 6-week-old oilseed rape (*Brassica napus* variety SW Oban; source: Nick Balaam, Sw Seed Ltd., 49 North Road, Abington, Cambridge, CB1 6AS, UK) in aluminium-framed cages containing 70 μm mesh in a controlled environment chamber with the following conditions: 23±2° C. and 60±5% relative humidity, with a 16:8 hours light:dark photoperiod.

One day prior to the start of the bioassay, adults were collected from the rearing cages and placed on fresh detached oilseed rape leaves in a Petri dish and left overnight in the insect chamber. The following day, first-instar nymphs were picked and transferred to feeding chambers. A feeding chamber comprised of 10 first instar nymphs placed in a small Petri dish (with diameter 3 cm) covered with a single layer of thinly stretched parafilm M onto which 50 μl of diet was added. The chamber was sealed with a second layer of parafilm and incubated under the same conditions as the adult cultures. Diet with dsRNA was refreshed every other day and the insects' survival assessed on day 8 i.e. $8^{th}$ day post bioassay start. Per treatment, 5 bioassay feeding chambers (replicates) were set up simultaneously. Test and control (gfp) dsRNA solutions were incorporated into the diet to a final concentration of 2 μg/μl. The feeding chambers were kept at 23±2° C. and 60±5% relative humidity, with a 16:8 hours light:dark photoperiod. A Mann-Whitney test was determined by GraphPad Prism version 4 to establish whether the medians do differ significantly between target 27 (MP027) and gfp dsRNA.

In the bioassay, feeding liquid artificial diet supplemented with intact naked dsRNA from target 27 (SEQ ID NO 1061) to nymphs of *Myzus persicae* using a feeding chamber, resulted in a significant increase in mortality, as shown in FIG. 1. Average percentage survivors for target 27, gfp dsRNA and diet only treatment were 2, 34 and 82, respectively. Comparison of target 027 with gfp dsRNA groups using the Mann-Whitney test resulted in an one-tailed P-value of 0.004 which indicates that the median of target 027 is significantly different ($P<0.05$) from the expected larger median of gfp dsRNA. The green peach aphids on the liquid diet with incorporated target 27 dsRNA were noticeably smaller than those that were fed on diet only or with gfp dsRNA control (data not presented).

E. Laboratory Trials of *Myzus periscae* (Green Peach Aphid) Infestation on Transgenic *Arabidopsis thaliana* Plants Generation of Transgenic Plants

*Arabidopsis thaliana* plants were transformed using the floral dip method (Clough and Bent (1998) *Plant Journal* 16:735-743). Aerial parts of the plants were incubated for a few seconds in a solution containing 5% sucrose, resuspended *Agrobacterium tumefaciens* strain C58C1 Rif cells from an overnight culture and 0.03% of the surfactant Silwet L-77. After inoculation, plants were covered for 16 hours with a transparent plastic to maintain humidity. To increase the transformation efficiency, the procedure was repeated after one week. Watering was stopped as seeds matured and dry seeds were harvested and cold-treated for two days. After sterilization, seeds were plated on a kanamycin-containing growth medium for selection of transformed plants.

The selected plants are transferred to soil for optimal T2 seed production.

Bioassay

Transgenic *Arabidopsis thaliana* plants are selected by allowing the segregating T2 seeds to germinate on appropriate selection medium. When the roots of these transgenics are well-established they are then transferred to fresh artificial growth medium or soil and allowed to grow under optimal conditions. Whole transgenic plants are tested against nymphs of the green peach aphid (*Myzus persicae*) to show (1) a significant resistance to plant damage by the feeding nymph, (2) increased nymphal mortality, and/or (3) decreased weight of nymphal survivors (or any other aberrant insect development).

Example 9

*Nilaparvata lugens* (Brown Plant Hopper)

A. Cloning *Nilaparvata lugens* Partial Sequences

From high quality total RNA of *Nilaparvata lugens* (source: Dr. J. A. Gatehouse, Dept. Biological Sciences, Durham University, UK) cDNA was generated using a commercially available kit (SuperScript™ III Reverse Transcriptase, Cat N°. 18080044, Invitrogen, Rockville, Md., USA) following the manufacturer's protocol.

To isolate cDNA sequences comprising a portion of the *Nilaparvata lugens* NL001, NL002, NL003, NL004, NL005, NL006, NL007, NL008, NL009, NL010, NL011, NL012, NL013, NL014, NL015, NL016, NL018, NL019, NL021, NL022, and NL027 genes, a series of PCR reactions with degenerate primers were performed using Amplitaq Gold (Cat N°. N8080240; Applied Biosystems) following the manufacturer's protocol.

The sequences of the degenerate primers used for amplification of each of the genes are given in Table 2-NL. These primers were used in respective PCR reactions with the following conditions: for NL001: 5 minutes at 95° C., followed by 40 cycles of 30 seconds at 95° C., 1 minute at 55° C. and 1 minute at 72° C., followed by 10 minutes at 72° C.: for NL002: 3 minutes at 95° C., followed by 40 cycles of 30 seconds at 95° C., 1 minute at 55° C. and 1 minute at 72° C., followed by 10 minutes at 72° C.; for NL003: 3 minutes at 95° C., followed by 40 cycles of 30 seconds at 95° C., 1 minute at 61° C. and 1 minute at 72° C., followed by 10 minutes at 72° C.; for NL004: 10 minutes at 95° C., followed by 40 cycles of 30 seconds at 95° C., 1 minute at 51° C. and 1 minute at 72° C.; for NL005: 10 minutes at 95° C., followed by 40 cycles of 30 seconds at 95° C., 1 minute at 54° C. and 1 minute at 72° C., followed by 10 minutes at 72° C.; for NL006: 10 minutes at 95° C., followed by 40 cycles of 30 seconds at 95° C., 1 minute at 55° C. and 3 minute 30 seconds at 72° C., followed by 10 minutes at 72° C.; for NL007: 10 minutes at 95° C., followed by 40 cycles of 30 seconds at 95° C., 1 minute at 54° C. and 1 minute 15 seconds at 72° C., followed by 10 minutes at 72° C.; for NL008 & NL014: 10 minutes at 95° C., followed by 40 cycles of 30 seconds at 95° C., 1 minute at 53° C. and 1 minute at 72° C., followed by 10 minutes at 72° C.; for NL009, NL011, NL012 & NL019: 10 minutes at 95° C., followed by 40 cycles of 30 seconds at 95° C., 1 minute at 55° C. and 1 minute at 72° C., followed by 10 minutes at 72° C.; for NL010: 10 minutes at 95° C., followed by 40 cycles of 30 seconds at 95° C., 1 minute at 54° C. and 2 minute 30 seconds at 72° C., followed by 10 minutes at 72° C.; for NL013: 10 minutes at 95° C., followed by 40 cycles of 30 seconds at 95° C., 1 minute at 54° C. and 1 minute 10 seconds at 72° C., followed by 10 minutes at 72° C.; for NL015 & NL016: 10 minutes at 95° C., followed by 40 cycles of 30 seconds at 95° C., 1 minute at 54° C. and 1 minute 40 seconds at 72° C., followed by 10 minutes at 72° C.; for NL018: 10 minutes at 95° C., followed by 40 cycles of 30 seconds at 95° C., 1 minute at 54° C. and 1 minute 35 seconds at 72° C., followed by 10 minutes at 72° C.; for NL021, NL022 & NL027: 10 minutes at 95° C., followed by 40 cycles of 30 seconds at 95° C., 1 minute at 54° C. and 1 minute 45 seconds at 72° C., followed by 10 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen), and sequenced. The sequences of the resulting PCR products are represented by the respective SEQ ID NOs as given in Table 2-NL and are referred to as the partial sequences. The corresponding partial amino acid sequences are represented by the respective SEQ ID NOs as given in Table 3-NL.

B. Cloning of a Partial Sequence of the *Nilaparvata lugens* NL023 Gene Via EST Sequence From high quality total RNA of *Nilaparvata lugens* (source: Dr. J. A. Gatehouse, Dept. Biological Sciences, Durham University, UK) cDNA was generated using a commercially available kit (SuperScript™ III Reverse Transcriptase, Cat N°. 18080044, Invitrogen, Rockville, Md., USA) following the manufacturer's protocol.

A partial cDNA sequence, NL023, was amplified from *Nilaparvata lugens* cDNA which corresponded to a *Nilaparvata lugens* EST sequence in the public database Genbank with accession number CAH65679.2. To isolate cDNA sequences comprising a portion of the NL023 gene, a series of PCR reactions with EST based specific primers were performed using PerfectShot™ ExTaq (Cat N°. RR005A, Takara Bio Inc.) following the manafacturer's protocol.

For NL023, the specific primers oGBKW002 and oGBKW003 (represented herein as SEQ ID NO 1157 and SEQ ID NO 1158, respectively) were used in two independent PCR reactions with the following conditions: 3 minutes at 95° C., followed by 30 cycles of 30 seconds at 95° C., 30 seconds at 56° C. and 2 minutes at 72° C., followed by 10 minutes at 72° C. The resulting PCR products were analyzed on agarose gel, purified (QIAquick® Gel Extraction Kit; Cat. N°. 28706, Qiagen), cloned into the pCR4-TOPO vector (Cat N°. K4575-40, Invitrogen) and sequenced. The consensus sequence resulting from the sequencing of both PCR products is herein represented by SEQ ID NO 1111 and is referred to as the partial sequence of the NL023 gene. The corresponding partial amino acid sequence is herein represented as SEQ ID NO 1112.

C. dsRNA Production of *Nilaparvata lugens* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-NL. The conditions in the PCR reactions were as follows: for NL001 & NL002: 4 minutes at 94° C., followed by 35 cycles of 30 seconds at 94° C., 30 seconds at 60° C. and 1 minute at 72° C., followed by 10 minutes at 72° C.; for NL003: 4 minutes at 94° C., followed by 35 cycles of 30 seconds at 94° C., 30 seconds at 66° C. and 1 minute at 72° C., followed by 10 minutes at 72° C.; for NL004, NL006, NL008, NL009, NL010 & NL019: 4 minutes at 95° C., followed by 35 cycles of 30 seconds at 95° C., 30 seconds at 54° C. and 1 minute at 72° C., followed by 10 minutes at 72° C.; for NL005 & NL016: 4 minutes at 95° C., followed by 35 cycles of 30 seconds at 95° C., 30 seconds at 57° C. and 1 minute at 72° C., followed by 10 minutes at 72° C.; for NL007 & NL014: 4 minutes at 95° C., followed by 35 cycles of 30 seconds at 95° C., 30 seconds at 51° C. and 1 minute at 72° C., followed by 10 minutes at 72° C.; for NL011, NL012 & NL022: 4 minutes at 95° C., followed by 35 cycles of 30 seconds at 95° C., 30 seconds at 53° C. and 1 minute at 72° C., followed by 10 minutes at 72° C.; for NL013, NL015, NL018 & NL021: 4 minutes at 95° C., followed by 35 cycles of 30 seconds at 95° C., 30 seconds at 55° C. and 1 minute at 72° C., followed by 10 minutes at 72° C.; for NL023 & NL027: 4 minutes at 95° C., followed by 35 cycles of 30 seconds at 95° C., 30 seconds at 52° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-NL. The resulting PCR products were analyzed on agarose gel and purified by PCR purification kit (Qiaquick PCR Purification Kit, Cat. Nr. 28106, Qiagen). The generated T7 forward and reverse templates were mixed to be transcribed and the resulting RNA strands were annealed, DNase and RNase treated, and purified by sodium acetate, following the manufacturer's instructions, but with the following modification: RNA peppet is washed twice in 70% ethanol. The sense strand of the resulting dsRNA for each of the target genes is given in Table 8-NL.

The template DNA used for the PCR reactions with T7 primers on the green fluorescent protein (gfp) control was the plasmid pPD96.12 (courtesy of the Andrew Fire Lab, Standford Unversity), which contains the wild-type gfp coding sequence interspersed by 3 synthetic introns. Double stranded RNA was synthesized using the commercially available kit T7 RiboMAX™ Express RNAi System (Cat. No. P1 700, Promega). First two separate single 5' T7 RNA polymerase promoter templates were generated in two separate PCR reactions, each reaction containing the target sequence in a different orientation relative to the T7 promoter. For gfp, the sense T7 template was generated using the specific T7 FW primer oGAU183 and the specific RV primer oGAU182 (represented herein as SEQ ID NO 236 and SEQ ID NO 237, respectively) in a PCR reaction with the following conditions: 4 minutes at 95° C., followed by 35 cycles of 30 seconds at 95° C., 30 seconds at 55° C. and 1 minute at 72° C., followed by 10 minutes at 72° C. The anti-sense T7 template was generated using the specific FW primer oGAU181 and the specific T7 RV primer oGAU184 (represented herein as SEQ ID NO 238 and SEQ ID NO 239, respectively) in a PCR reaction with the same conditions as described above. The resulting PCR products were analyzed on agarose gel and purified (QIAquick® PCR Purification Kit; Cat. N°. 28106, Qiagen). The generated T7 FW and RV templates were mixed to be transcribed and the resulting RNA strands were annealed, DNase and RNase treated, and purified by precipitation with sodium acetate and isopropanol, following the manufacturer's protocol, but with the following modification: RNA peppet is washed twice in 70% ethanol. The sense strands of the resulting dsRNA is herein represented by SEQ ID NO 235.

D. Laboratory Trials to Screen dsRNA Targets Using Liquid Artificial Diet for Activity Against *Nilaparvata lugens*

Liquid artificial diet (MMD-1) for the rice brown planthopper, *Nilaparvata lugens*, was prepared as described by Koyama (1988) [Artificial rearing and nutritional physiology of the planthoppers and leafhoppers (Homoptera: Delphacidae and Deltocephalidae) on a holidic diet. *JARQ* 22: 20-27], but with a modification in final concentration of diet component sucrose: 14.4% (weight over volume) was used. Diet components were prepared as separate concentrates: 10× mineral stock (stored at 4° C.), 2× amino acid stock (stored at −20° C.) and 10× vitamin stock (stored at −20° C.). The stock components were mixed immediately prior to the start of a bioassay to 4/3× concentration to allow dilution with the test dsRNA solution (4× concentration), pH adjusted to 6.5, and filter-sterilised into approximately 500 μl aliquots.

Rice brown planthopper (*Nilaparvata lugens*) was reared on two-to-three month old rice (*Oryza sativa* cv Taichung Native 1) plants in a controlled environment chamber: 27±2° C., 80% relative humidity, with a 16:8 hours light:dark photoperiod. A feeding chamber comprised 10 first or second instar nymphs placed in a small petri dish (with diameter 3 cm) covered with a single layer of thinly stretched parafilm M onto which 50 μl of diet was added. The chamber was sealed with a second layer of parafilm and incubated under the same conditions as the adult cultures but with no direct light exposure. Diet with dsRNA was refreshed every other day and the insects' survival assessed daily. Per treatment, 5 bioassay feeding chambers (replicates) were set up simultaneously. Test and control (gfp) dsRNA solutions were incorporated into the diet to a final concentration of 2 mg/ml. The feeding chambers were kept at 27±2° C., 80% relative humidity, with a 16:8 hours light:dark photoperiod. Insect survival data were analysed using the Kaplan-Meier survival curve model and the survival between groups were compared using the logrank test (Prism version 4.0).

Feeding liquid artificial diet supplemented with intact naked dsRNAs to *Nilaparvata lugens* in vitro using a feeding chamber resulted in significant increases in nymphal mortalities as shown in four separate bioassays (FIGS. 1(*a*)-(*d*)-NL; Tables 10-NL(a)-(d)) (Durham University). These results demonstrate that dsRNAs corresponding to different essential BPH genes showed significant toxicity towards the rice brown planthopper.

Effect of gfp dsRNA on BPH survival in these bioassays is not significantly different to survival on diet only Tables 10-NL(a)-(d) show a summary of the survival of *Nilaparvata lugens* on artificial diet supplemented with 2 mg/ml (final concentration) of the following targets; in Table 10-NL(a): NL002, NL003, NL005, NL010; in Table 10-NL (b): NL009, NL016; in Table 10-NL(c): NL014, NL018; and in Table 10-NL(d): NL013, NL015, NL021. In the survival analysis column, the effect of RNAi is indicated as follows: +=significantly decreased survival compared to gfp dsRNA control (alpha<0.05); −=no significant difference in survival compared to gfp dsRNA control. Survival curves were compared (between diet only and diet supplemented with test dsRNA, gfp dsRNA and test dsRNA, and diet only and gfp dsRNA) using the logrank test.

E. Laboratory Trials to Screen dsRNAs at Different Concentrations Using Artificial Diet for Activity Against *Nilaparvata lugens*

Fifty µl of liquid artificial diet supplemented with different concentrations of target NL002 dsRNA, namely 1, 0.2, 0.08, and 0.04 mg/ml (final concentration), was applied to the brown planthopper feeding chambers. Diet with dsRNA was refreshed every other day and the insects' survival assessed daily. Per treatment, 5 bioassay feeding chambers (replicates) were set up simultaneously. The feeding chambers were kept at 27±2° C., 80% relative humidity, with a 16:8 hours light:dark photoperiod. Insect survival data were analysed using the Kaplan-Meier survival curve model and the survival between groups were compared using the logrank test (Prism version 4.0).

Feeding liquid artificial diet supplemented with intact naked dsRNAs of target NL002 at different concentrations resulted in significantly higher BPH mortalities at final concentrations of as low as 0.04 mg dsRNA per ml diet when compared with survival on diet only, as shown in FIG. 2-NL and Table 11-NL. Table 11-NL summarizes the survival of *Nilaparvata lugens* artificial diet feeding trial supplemented with 1, 0.2, 0.08, & 0.04 mg/ml (final concentration) of target NL002. In the survival analysis column the effect of RNAi is indicated as follows: +=significantly decreases survival compared to diet only control (alpha<0.05); −=no significant differences in survival compared to diet only control. Survival curves were compared using the logrank test.

Example 10

*Chilo suppressalis* (Rice Striped Stem Borer)

A. Cloning of Partial Sequence of the *Chilo suppressalis* Genes Via Family PCR

High quality, intact RNA was isolated from the 4 different larval stages of *Chilo suppressalis* (rice striped stem borer) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the CS001, CS002, CS003, CS006, CS007, CS009, CS011, CS013, CS014, CS015, CS016 and CS018 genes, a series of PCR reactions with degenerate primers were performed using Amplitaq Gold (Cat. Nr. N8080240, Applied Biosystems) following the manufacturer's instructions.

The sequences of the degenerate primers used for amplification of each of the genes are given in Table 2-CS. These primers were used in respective PCR reactions with the following conditions: 10 minutes at 95° C., followed by 40 cycles of 30 seconds at 95° C., 1 minute at 55° C. and 1 minute at 72° C., followed by 10 minutes at 72° C. The resulting PCR fragments were analyzed on agarose gel, purified (QIAquick Gel Extraction kit, Cat. Nr. 28706, Qiagen), cloned into the pCR4/TOPO vector (Cat. Nr. K2500-20, Invitrogen), and sequenced. The sequences of the resulting PCR products are represented by the respective SEQ ID NOs as given in Table 2-CS and are referred to as the partial sequences. The corresponding partial amino acid sequences are represented by the respective SEQ ID NOs as given in Table 3-CS.

B. dsRNA Production of the *Chilo suppressalis* Genes dsRNA was synthesized in milligram amounts using the commercially available kit T7 Ribomax™ Express RNAi System (Cat. Nr. P1700, Promega). First two separate single 5′ T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-CS. The conditions in the PCR reactions were as follows: 4 minutes at 95° C., followed by 35 cycles of 30 seconds at 95° C., 30 seconds at 55° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-CS. The resulting PCR products were analyzed on agarose gel and purified by PCR purification kit (Qiaquick PCR Purification Kit, Cat. Nr. 28106, Qiagen) and NaClO$_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-CS.

C. Recombination of the *Chilo suppressalis* Genes into the Plant Vector pK7GWIWG2D(II)

Since the mechanism of RNA interference operates through dsRNA fragments, the target nucleotide sequences of the target genes, as selected above, are cloned in antisense and sense orientation, separated by the intron—CmR-intron, whereby CmR is the chloramphenicol resistance marker, to form a dsRNA hairpin construct. These hairpin constructs are generated using the LR recombination reaction between an attL-containing entry clone (see Example 10A) and an attR-containing destination vector (=pK7GWIWG2D(II)). The plant vector pK7GWIWG2D (II) is obtained from the VIB/Plant Systems Biology with a Material Transfer Agreement. LR recombination reaction is performed by using LR Clonase™ II enzyme mix (Cat. Nr. 11791-020, Invitrogen) following the manufacturer's instructions. These cloning experiments result in a hairpin construct for each of the target genes, having the promoter—sense-intron-CmR-intron-antisense orientation, and wherein the promoter is the plant operable 35S promoter. The binary vector pK7GWIWG2D(II) with the 35S promoter is suitable for transformation into *A. tumefaciens*.

Restriction enzyme digests were carried out on pCR8/GW/TOPO plasmids containing the different targets (see Example 10B). The band containing the gene of interest flanked by the attL sites using Qiaquick Gel Extraction Kit (Cat. Nr. 28706, Qiagen) is purified. An amount of 150 ng of purified fragment and 150 ng pK7GWIWG2D(II) is added together with the LR clonase II enzyme and incubated for at least 1 h at 25° C. After proteinase K solution treatment (10 min at 37° C.), the whole recombination mix is transformed into Top 10 chemically competent cells. Positive clones are selected by restriction digest analyses.

D. Laboratory Trials to Test dsRNA Targets, Using Artificial Diet for Activity Against *Chilo suppressalis* Larvae Rice striped stem borers, *Chilo suppressalis*, (origin: Syngenta, Stein, Switzerland) were maintained on a modified artificial diet based on that described by Kamano and Sato, 1985 (in: Handbook of Insect Rearing. Volumes I & II. P Singh and RF Moore, eds., Elsevier Science Publishers, Amsterdam and New York, 1985, pp 448). Briefly, a litre diet was made up as follows: 20 g of agar added to 980 ml of Milli-Q water and autoclaved; the agar solution was cooled down to approximately 55° C. and the remaining ingredients were added and mixed thoroughly: 40 g corn flour (Polenta), 20 g cellulose, 30 g sucrose, 30 g casein, 20 g wheat germ (toasted), 8 g Wesson salt mixture, 12 g Vanderzant vitamin mix, 1.8 g sorbic acid, 1.6 g nipagin (methylparaben), 0.3 g aureomycin, 0.4 g cholesterol and 0.6 g L-cysteine. The diet was cooled down to approx. 45° C. and poured into rearing trays or cups. The diet was left to set in a horizontal laminair flow cabin. Rice leaf sections with oviposited eggs were removed from a cage housing adult moths and pinned to the solid diet in the rearing cup or tray. Eggs were left to hatch and neonate larvae were available for bioassays and the maintenance of the insect cultures. During the trials and rearings, the conditions were 28±2° C. and 80±5% relative humidity, with a 16:8 hour light:dark photoperiod.

The same artificial diet is used for the bioassays but in this case the diet is poured equally in 24 multiwell plates, with each well containing 1 ml diet. Once the diet is set, the test formulations are applied to the diet's surface (2 cm²), at the rate of 50 µl of 1 µg/µl dsRNA of target. The dsRNA solutions are left to dry and two first instar moth larvae are placed in each well. After 7 days, the larvae are transferred to fresh treated diet in multiwell plates. At day 14 (i.e. 14 days post bioassay start) the number of live and dead insects is recorded and examined for abnormalities. Twenty-four larvae in total are tested per treatment.

An alternative bioassay is performed in which treated rice leaves are fed to neonate larvae of the rice striped stem borer. Small leaf sections of Indica rice variety Taichung native 1 are dipped in 0.05% Triton X-100 solution containing 1 µg/µl of target dsRNA, left to dry and each section placed in a well of a 24 multiwell plate containing gellified 2% agar. Two neonates are transferred from the rearing tray to each dsRNA treated leaf section (24 larvae per treatment). After 4 and 8 days, the larvae are transferred to fresh treated rice leaf sections. The number of live and dead larvae are assessed on days 4, 8 and 12; any abnormalities are also recorded.

Example 11

*Plutella xylostella* (Diamondback Moth)

A. Cloning of a Partial Sequence of the *Plutella xylostella*

High quality, intact RNA was isolated from all the different larval stages of *Plutella xylostella* (Diamondback moth; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the PX001, PX009, PX010, PX015, PX016 genes, a series of PCR reactions with degenerate primers were performed using Amplitaq Gold (Cat. Nr. N8080240, Applied Biosystems) following the manufacturer's instructions. The sequences of the degenerate primers used for amplification of each of the genes are given in Table 2-PX. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. (for PX001, PX009, PX015, PX016); 10 minutes at 95° C., followed by 40 cycles of 30 seconds at 95° C., 1 minute at 54° C. and 2 minute and 30 seconds at 72° C., followed by 7 minutes at 72° C. (for PX010). The resulting PCR fragments were analyzed on agarose gel, purified (QIAquick Gel Extraction kit, Cat. Nr. 28706, Qiagen), cloned into the pCR8/GW/TOPO vector (Cat. Nr. K2500-20, Invitrogen) and sequenced. The sequences of the resulting PCR products are represented by the respective SEQ ID NOs as given in Table 2-PX and are referred to as the partial sequences. The corresponding partial amino acid sequence are represented by the respective SEQ ID NOs as given in Table 3-PX.

B. dsRNA Production of the *Plutella xylostella* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-PX. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-PX. The resulting PCR products were analyzed on agarose gel and purified by PCR purification kit (Qiaquick PCR Purification Kit, Cat. Nr. 28106, Qiagen) and NaClO₄ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-PX.

C. Recombination of the *Plutella xylostella* Genes into the Plant Vector pK7GWIWG2D(II)

Since the mechanism of RNA interference operates through dsRNA fragments, the target nucleotide sequences of the target genes, as selected above, are cloned in anti-sense and sense orientation, separated by the intron—CmR-intron, whereby CmR is the chloramphenicol resistance marker, to form a dsRNA hairpin construct. These hairpin constructs are generated using the LR recombination reaction between an attL-containing entry clone (see Example 11A) and an attR-containing destination vector (=pK7GWIWG2D(II)). The plant vector pK7GWIWG2D (II) is obtained from the VIB/Plant Systems Biology with a Material Transfer Agreement. LR recombination reaction is performed by using LR Clonase™ II enzyme mix (Cat. Nr. 11791-020, Invitrogen) following the manufacturer's instructions. These cloning experiments result in a hairpin construct for each of the target genes, having the promoter— sense-intron-CmR-intron-antisense orientation, and wherein the promoter is the plant operable 35S promoter. The binary vector pK7GWIWG2D(II) with the 35S promoter is suitable for transformation into *A. tumefaciens*.

Restriction enzyme digests were carried out on pCR8/GW/TOPO plasmids containing the different targets (see Example 11B). The band containing the gene of interest flanked by the attL sites using Qiaquick Gel Extraction Kit (Cat. Nr. 28706, Qiagen) is purified. An amount of 150 ng of purified fragment and 150 ng pK7GWIWG2D(II) is added together with the LR clonase II enzyme and incubated for at least 1 h at 25° C. After proteinase K solution treatment (10 min at 37° C.), the whole recombination mix is transformed into Top 10 chemically competent cells. Positive clones are selected by restriction digest analyses.

D. Laboratory Trials to Test dsRNA Targets, Using Artificial Diet for Activity Against *Plutella xylostella* Larvae Diamond-back moths, *Plutella xylostella*, were maintained at Insect Investigations Ltd. (origin: Newcastle University, Newcastle-upon-Tyne, UK). The insects were reared on cabbage leaves. First instar, mixed sex larvae (approximately 1 day old) were selected for use in the trial. Insects were maintained in Eppendorf tubes (1.5 ml capacity). Commercially available Diamond-back moth diet (Bio-Serv, NJ, USA), prepared following the manufacturer's instructions, was placed in the lid of each tube (0.25 ml capacity, 8 mm diameter). While still liquid, the diet was smoother over to remove excess and produce an even surface.

Once the diet has set the test formulations are applied to the diet's surface, at the rate of 25 µl undiluted formulation (1 µg/µl dsRNA of targets) per replicate. The test formulations are allowed to dry and one first instar moth larva is placed in each tube. The larva is placed on the surface of the diet in the lid and the tube carefully closed. The tubes are stored upside down, on their lids such that each larva remains on the surface of the diet. Twice weekly the larvae are transferred to new Eppendorf tubes with fresh diet. The insects are provided with treated diet for the first two weeks of the trial and thereafter with untreated diet.

Assessments are made twice weekly for a total of 38 days at which point all larvae are dead. At each assessment the insects are assessed as live or dead and examined for abnormalities. Forty single larva replicates are performed for each of the treatments. During the trial the test conditions are 23 to 26° C. and 50 to 65% relative humidity, with a 16:8 hour light:dark photoperiod.

Example 12

*Acheta domesticus* (House Cricket)

A. Cloning *Acheta domesticus* Partial Sequences

High quality, intact RNA was isolated from all the different insect stages of *Acheta domesticus* (house cricket; source: Dr. Lara Senior, Insect Investigations Ltd., Capital Business Park, Wentloog, Cardiff, CF3 2PX, Wales, UK) using TRIzol Reagent (Cat. Nr. 15596-026/15596-018, Invitrogen, Rockville, Md., USA) following the manufacturer's instructions. Genomic DNA present in the RNA preparation was removed by DNase treatment following the manufacturer's instructions (Cat. Nr. 1700, Promega). cDNA was generated using a commercially available kit (SuperScript™ III Reverse Transcriptase, Cat. Nr. 18080044, Invitrogen, Rockville, Md., USA) following the manufacturer's instructions.

To isolate cDNA sequences comprising a portion of the AD001, AD002, AD009, AD015 and AD016 genes, a series of PCR reactions with degenerate primers were performed using Amplitaq Gold (Cat. Nr. N8080240, Applied Biosystems) following the manafacturer's instructions.

The sequences of the degenerate primers used for amplification of each of the genes are given in Table 2-AD. These primers were used in respective PCR reactions with the following conditions: 10 minutes at 95° C., followed by 40 cycles of 30 seconds at 95° C., 1 minute at 50° C. and 1 minute and 30 seconds at 72° C., followed by 7 minutes at 72° C. The resulting PCR fragments were analyzed on agarose gel, purified (QIAquick Gel Extraction kit, Cat. Nr. 28706, Qiagen), cloned into the pCR8/GW/topo vector (Cat. Nr. K2500 20, Invitrogen) and sequenced. The sequences of the resulting PCR products are represented by the respective SEQ ID NOs as given in Table 2-AD and are referred to as the partial sequences. The corresponding partial amino acid sequence are represented by the respective SEQ ID NOs as given in Table 3-AD.

B. dsRNA Production of the *Acheta domesticus* Genes dsRNA was synthesized in milligram amounts using the commercially available kit T7 Ribomax™ Express RNAi System (Cat. Nr. P1700, Promega). First two separate single 5' T7 RNA polymerase promoter templates were generated in two separate PCR reactions, each reaction containing the target sequence in a different orientation relative to the T7 promoter.

For each of the target genes, the sense T7 template was generated using specific T7 forward and specific reverse primers. The sequences of the respective primers for amplifying the sense template for each of the target genes are given in Table 8-AD. The conditions in the PCR reactions were as follows: 1 minute at 95° C., followed by 20 cycles of 30 seconds at 95° C., 30 seconds at 60° C. (−0.5° C./cycle) and 1 minute at 72° C., followed by 15 cycles of 30 seconds at 95° C., 30 seconds at 50° C. and 1 minute at 72° C., followed by 10 minutes at 72° C. The anti-sense T7 template was generated using specific forward and specific T7 reverse primers in a PCR reaction with the same conditions as described above. The sequences of the respective primers for amplifying the anti-sense template for each of the target genes are given in Table 8-AD. The resulting PCR products were analyzed on agarose gel and purified by PCR purification kit (Qiaquick PCR Purification Kit, Cat. Nr. 28106, Qiagen) and $NaClO_4$ precipitation. The generated T7 forward and reverse templates were mixed to be transcribed and the resulting RNA strands were annealed, DNase and RNase treated, and purified by sodium acetate, following the manufacturer's instructions. The sense strand of the resulting dsRNA for each of the target genes is given in Table 8-AD.

C. Recombination of the *Acheta domesticus* Genes into the Plant Vector pK7GWIWG2D(II)

Since the mechanism of RNA interference operates through dsRNA fragments, the target nucleotide sequences of the target genes, as selected above, are cloned in anti-sense and sense orientation, separated by the intron—CmR-intron, whereby CmR is the chloramphenicol resistance marker, to form a dsRNA hairpin construct. These hairpin constructs are generated using the LR recombination reaction between an attL-containing entry clone (see Example 12A) and an attR-containing destination vector (=pK7GWIWG2D(II)). The plant vector pK7GWIWG2D (II) is obtained from the VIB/Plant Systems Biology with a Material Transfer Agreement. LR recombination reaction is performed by using LR Clonase™ II enzyme mix (Cat. Nr. 11791-020, Invitrogen) following the manufacturer's instructions. These cloning experiments result in a hairpin construct for each of the target genes, having the promoter—sense-intron-CmR-intron-antisense orientation, and wherein the promoter is the plant operable 35S promoter. The binary vector pK7GWIWG2D(II) with the 35S promoter is suitable for transformation into *A. tumefaciens*.

Restriction enzyme digests were carried out on pCR8/GW/TOPO plasmids containing the different targets (see Example 12B). The band containing the gene of interest flanked by the attL sites using Qiaquick Gel Extraction Kit (Cat. Nr. 28706, Qiagen) is purified. An amount of 150 ng of purified fragment and 150 ng pK7GWIWG2D(II) is added together with the LR clonase II enzyme and incubated for at least 1 h at 25° C. After proteinase K solution treatment (10 min at 37° C.), the whole recombination mix is transformed into Top 10 chemically competent cells. Positive clones are selected by restriction digest analyses.

D. Laboratory Trials to Test dsRNA Targets, Using Artificial Diet for Activity Against *Acheta domesticus* Larvae House crickets, *Acheta domesticus*, were maintained at Insect Investigations Ltd. (origin: Blades Biological Ltd., Kent, UK). The insects were reared on bran pellets and cabbage leaves. Mixed sex nymphs of equal size and no more than 5 days old were selected for use in the trial. Double-stranded RNA is mixed with a wheat-based pelleted rodent diet (rat and mouse standard diet, B & K Universal Ltd., Grimston, Aldbrough, Hull, UK). The diet, BK001P, contains the following ingredients in descending order by weight: wheat, soya, wheatfeed, barley, pellet binder, rodent 5 vit min, fat blend, dicalcium phosphate, mould carb. The pelleted rodent diet is finely ground and heat-treated in a microwave oven prior to mixing, in order to inactivate any enzyme components. All rodent diet is taken from the same batch in order to ensure consistency. The ground diet and dsRNA are mixed thoroughly and formed into small pellets of equal weight, which are allowed to dry overnight at room temperature.

Double-stranded RNA samples from targets and gfp control at concentrations 10 µg/µl were applied in the ratio 1 g ground diet plus 1 ml dsRNA solution, thereby resulting in an application rate of 10 mg dsRNA per g pellet. Pellets are replaced weekly. The insects are provided with treated pellets for the first three weeks of the trial. Thereafter untreated pellets are provided. Insects are maintained within lidded plastic containers (9 cm diameter, 4.5 cm deep), ten per container. Each arena contains one treated bait pellet and one water source (damp cotton wool ball), each placed in a separate small weigh boat. The water is replenished ad lib throughout the experiment.

Assessments are made at twice weekly intervals, with no more than four days between assessments, until all the control insects had either died or moulted to the adult stage (84 days). At each assessment the insects are assessed as live or dead, and examined for abnormalities. From day 46 onwards, once moulting to adult has commenced, all insects (live and dead) are assessed as nymph or adult. Surviving insects are weighed on day 55 of the trial. Four replicates are performed for each of the treatments. During the trial the test conditions are 25 to 33° C. and 20 to 25% relative humidity, with a 12:12 hour light:dark photoperiod.

TABLE 1A

| *C. elegans* id | *D. melanogaster* id | description | devgen RNAi screen |
| --- | --- | --- | --- |
| B0250.1 | CG1263 | large ribosomal subunit L8 protein. | Acute lethal or lethal |
| B0336.10 | CG3661 | large ribosomal subunit L23 protein. | Acute lethal or lethal |
| B0336.2 | CG8385 | ADP-ribosylation factor | Acute lethal or lethal |
| B0464.1 | CG3821 | Putative aspartyl(D) tRNA synthetase. | Acute lethal or lethal |
| C01G8.5 | CG10701 | Ortholog of the ERM family of cytoskeletal linkers | Acute lethal or lethal |
| C01H6.5 | CG33183 | Nuclear hormone receptor that is required in all larval molts | Acute lethal or lethal |
| C02C6.1 | CG18102 | Member of the DYNamin related gene class | Acute lethal or lethal |
| C03D6.8 | CG6764 | Large ribosomal subunit L24 protein (Rlp24p) | Acute lethal or lethal |
| C04F12.4 | CG6253 | rpl-14 encodes a large ribosomal subunit L14 protein. | Acute lethal or lethal |
| C04H5.6 | CG10689 | Product with RNA helicase activity (EC: 2.7.7.—) involved in nuclear mRNA splicing, via spliceosome which is a component of the spliceosome complex | Embryonic lethal or sterile |
| C13B9.3 | CG14813 | Delta subunit of the coatomer (COPI) complex | Acute lethal or lethal |
| C17H12.14 | CG1088 | Member of the Vacuolar H ATPase gene class | Acute lethal or lethal |
| C26E6.4 | CG3180 | DNA-directed RNA polymerase II | Acute lethal or lethal |
| F23F12.6 | CG16916 | Triple A ATPase subunit of the 26S proteasome's 19S regulatory particle (RP) base subcomplex | Acute lethal or lethal |
| F57B9.10 | CG10149 | Member of the proteasome Regulatory Particle, Non-ATPase-like gene class | Acute lethal or lethal |
| K11D9.2 | CG3725 | sarco-endoplasmic reticulum Ca[2+] ATPase homolog | Embryonic lethal or sterile |
| T20G5.1 | CG9012 | Clathrin heavy chain | Acute lethal or lethal |
| T20H4.3 | CG5394 | Predicted cytoplasmic prolyl-tRNA synthetase (ProRS) | Acute lethal or lethal |
| T21E12.4 | CG7507 | Cytoplasmic dynein heavy chain homolog | Acute lethal or lethal |
| C05C10.3 | CG1140 | Orthologue to the human gene 3-OXOACID COA TRANSFERASE | Acute lethal or lethal |
| C09D4.5 | CG2746 | Ribosomal protein L19, structural constituent of ribosome involved in protein biosynthesis which is localised to the ribosome | Acute lethal or lethal |
| C09E10.2 | CG31140 | Orthologue of diacylglycerol kinase involved in movement, egg laying, and synaptic transmission, and is expressed in neurons. | Acute lethal or lethal |
| C13B9.3 | CG14813 | Delta subunit of the coatomer (COPI) | Acute lethal or lethal |
| C14B9.7 | CG12775 | Large ribosomal subunit L21 protein (RPL-21) involved in protein biosynthesis | Acute lethal or lethal |
| C15H11.7 | CG30382 | Type 6 alpha subunit of the 26S proteasome's 20S protease core particle (CP) | Acute lethal or lethal |
| C17E4.9 | CG9261 | Protein involved with Na+/K+-exchanging ATPase complex | Embryonic lethal or sterile |

TABLE 1A-continued

| C. elegans id | D. melanogaster id | description | devgen RNAi screen |
|---|---|---|---|
| C17H12.14 | CG1088 | V-ATPase E subunit | Acute lethal or lethal |
| C23G10.4 | CG11888 | Non-ATPase subunit of the 26S proteasome's 19S regulatory paritcle base subcomplex (RPN-2) | Acute lethal or lethal |
| C26D10.2 | CG7269 | Product with helicase activity involved in nuclear mRNA splicing, via spliceosome which is localized to the nucleus | Acute lethal or lethal |
| C26E6.4 | CG3180 | RNA polymerase II 140 kD subunit (RpII140), DNA-directed RNA polymerase activity (EC: 2.7.7.6) involved in transcription from Pol II promoter which is a component of the DNA-directed RNA polymerase II, core complex | Acute lethal or lethal |
| C26F1.4 | CG15697 | Product with function in protein biosynthesis and ubiquitin in protein degradation. | Acute lethal or lethal |
| C30C11.1 | CG12220 | Unknown function | Acute lethal or lethal |
| C30C11.2 | CG10484 | Member of the proteasome Regulatory Particle, Non-ATPase-like gene class | Acute lethal or lethal |
| C36A4.2 | CG13977 | cytochrome P450 | Acute lethal or lethal |
| C37C3.6 | CG33103 | Orthologous to thrombospondin, papilin and lacunin | Acute lethal or lethal |
| C37H5.8 | CG8542 | Member of the Heat Shock Protein gene class | Acute lethal or lethal |
| C39F7.4 | CG3320 | Rab-protein 1 involved in cell adhesion | Acute lethal or lethal |
| C41C4.8 | CG2331 | Transitional endoplasmic reticulum ATPase TER94, Golgi organization and biogenesis | Growth delay or arrested in growth |
| C42D8.5 | CG8827 | ACE-like protein | Acute lethal or lethal |
| C47E12.5 | CG1782 | Ubiquitin-activating enzyme, function in an ATP-dependent reaction that activates ubiquitin prior to its conjugation to proteins that will subsequently be degraded by the 26S proteasome. | Acute lethal or lethal |
| C47E8.5 | CG1242 | Member of the abnormal DAuer Formation gene class | Acute lethal or lethal |
| C49H3.11 | CG5920 | Small ribosomal subunit S2 protein. | Acute lethal or lethal |
| C52E4.4 | CG1341 | Member of the proteasome Regulatory Particle, ATPase-like gene class | Acute lethal or lethal |
| C56C10.3 | CG8055 | Carrier protein with putatively involved in intracellular protein transport | Growth delay or arrested in growth |
| CD4.6 | CG4904 | Type 1 alpha subunit of the 26S proteasome's 20S protease core particle (CP). | Acute lethal or lethal |
| D1007.12 | CG9282 | Large ribosomal subunit L24 protein. | Acute lethal or lethal |
| D1054.2 | CG5266 | Member of the Proteasome Alpha Subunit gene class | Acute lethal or lethal |
| D1081.8 | CG6905 | MYB transforming protein | Acute lethal or lethal |
| F07D10.1 | CG7726 | Large ribosomal subunit L11 protein (RPL-11.2) involved in protein biosynthesis. | Acute lethal or lethal |
| F11C3.3 | CG17927 | Muscle myosin heavy chain (MHC B) | Acute lethal or lethal |
| F13B10.2 | CG4863 | Large ribosomal subunit L3 protein (rpl-3) | Acute lethal or lethal |
| F16A11.2 | CG9987 | Methanococcus hypothetical protein 0682 like | Acute lethal or lethal |
| F20B6.2 | CG17369 | V-ATPase B subunit | Growth delay or arrested in growth |
| F23F12.6 | CG16916 | Triple A ATPase subunit of the 26S proteasome's 19S regulatory particle (RP) base subcomplex (RPT-3) | Acute lethal or lethal |
| F25H5.4 | CG2238 | Translation elongation factor 2 (EF-2), a GTP-binding protein involved in protein synthesis | Growth delay or arrested in growth |
| F26D10.3 | CG4264 | Member of the Heat Shock Protein gene class | Acute lethal or lethal |
| F28C6.7 | CG6846 | Large ribosomal subunit L26 protein (RPL-26) involved in protein biosynthesis | Embryonic lethal or sterile |
| F28D1.7 | CG8415 | Small ribosomal subunit S23 protein (RPS-23) involved in protein biosynthesis | Acute lethal or lethal |
| F29G9.5 | CG5289 | Member of the proteasome Regulatory Particle, ATPase-like gene class | Acute lethal or lethal |
| F32H2.5 | CG3523 | Mitochondrial protein | Acute lethal or lethal |
| F37C12.11 | CG2986 | Small ribosomal subunit S21 protein (RPS-21) involved in protein biosynthesis | Acute lethal or lethal |
| F37C12.4 | CG7622 | Large ribosomal subunit L36 protein (RPL-36) involved in protein biosynthesis | Acute lethal or lethal |
| F37C12.9 | CG1527 | Small ribosomal subunit S14 protein (RPS-14) involved in protein biosynthesis | Acute lethal or lethal |
| F38E11.5 | CG6699 | beta' (beta-prime) subunit of the coatomer (COPI) complex | Acute lethal or lethal |
| F39B2.6 | CG10305 | Small ribosomal subunit S26 protein (RPS-26) involved in protein biosynthesis | Acute lethal or lethal |
| F39H11.5 | CG12000 | Member of the Proteasome Beta Subunit gene class | Acute lethal or lethal |
| F40F8.10 | CG3395 | Ribosomal protein S9 (RpS9), structural constituent of ribosome involved in protein biosynthesis which is a component of the cytosolic small ribosomal subunit | Acute lethal or lethal |
| F42C5.8 | CG7808 | Small ribosomal subunit S8 protein (RPS-8) involved in protein biosynthesis | Acute lethal or lethal |
| F49C12.8 | CG5378 | Member of the proteasome Regulatory Particle, Non-ATPase-like gene class | Acute lethal or lethal |
| F53A3.3 | CG2033 | Small ribosomal subunit S15a protein. | Acute lethal or lethal |
| F53G12.10 | CG4897 | large ribosomal subunit L7 protein (rpl-7) | Acute lethal or lethal |
| F54A3.3 | CG8977 | Unknown function | Acute lethal or lethal |
| F54E2.3 | CG1915 | Product with sallimus (sls), myosin-light-chain kinase activity (EC: 2.7.1.117) involved in mitotic chromosome condensation which is localized to the nucleus | |
| F54E7.2 | CG11271 | Small ribosomal subunit S12 protein (RPS-12) involved in protein biosynthesis | Acute lethal or lethal |
| F55A11.2 | CG4214 | Member of the SYNtaxin gene class | Acute lethal or lethal |

TABLE 1A-continued

| C. elegans id | D. melanogaster id | description | devgen RNAi screen |
|---|---|---|---|
| F55A3.3 | CG1828 | transcritpion factor | Acute lethal or lethal |
| F55C10.1 | CG11217 | Ortholog of calcineurin B, the regulatory subunit of the protein phosphatase 2B | Acute lethal or lethal |
| F56F3.5 | CG2168 | rps-1 encodes a small ribosomal subunit S3A protein. | Acute lethal or lethal |
| F57B9.10 | CG10149 | Member of the proteasome Regulatory Particle, Non-ATPase-like gene class | Acute lethal or lethal |
| F58F12.1 | CG2968 | ATP synthase | Acute lethal or lethal |
| F59E10.3 | CG3948 | Zeta subunit of the coatomer (COPI) complex | Acute lethal or lethal |
| JC8.3 | CG3195 | Large ribosomal subunit L12 protein (rpl-12) | Acute lethal or lethal |
| K01G5.4 | CG1404 | Putative RAN small monomeric GTPase (cell adhesion) | Acute lethal or lethal |
| K04F10.4 | CG18734 | Subtilase | Acute lethal or lethal |
| K05C4.1 | CG12323 | Member of the Proteasome Beta Subunit gene class | Acute lethal or lethal |
| K07D4.3 | CG18174 | Putative proteasome regulatory particle, lid subcomplex, rpn11 | Acute lethal or lethal |
| K11D9.2 | CG3725 | Sarco-endoplasmic reticulum Ca[2+] ATPase | Embryonic lethal or sterile; Acute lethal or lethal |
| M03F4.2 | CG4027 | An actin that is expressed in body wall and vulval muscles and the spermatheca. | Acute lethal or lethal |
| R06A4.9 | CG1109 | six WD40 repeats | Acute lethal or lethal |
| R10E11.1 | CG15319 | Putative transcriptional cofactor | Acute lethal or lethal |
| R12E2.3 | CG3416 | Protein with endopeptidase activity involved in proteolysis and peptidolysis | Acute lethal or lethal |
| F10C1.2 | CG10119 | Member of the Intermediate Filament, B gene class | Embryonic lethal or sterile |
| F35G12.8 | CG11397 | Homolog of the SMC4 subunit of mitotic condensin | Embryonic lethal or sterile |
| F53G12.1 | CG5771 | GTPase homologue | Embryonic lethal or sterile |
| F54E7.3 | CG5055 | PDZ domain-containing protein | Embryonic lethal or sterile |
| H28O16.1 | CG3612 | ATP synthase | Growth delay or arrested in growth |
| K12C11.2 | CG4494 | Member of the SUMO (ubiquitin-related) homolog gene class | Embryonic lethal or sterile |
| R12E2.3 | CG3416 | Member of the proteasome Regulatory Particle, Non-ATPase-like gene class | Acute lethal or lethal |
| R13A5.8 | CG6141 | Ribosomal protein L9, structural constituent of ribosome involved in protein biosynthesis which is localised to the ribosome | Acute lethal or lethal |
| T01C3.6 | CG4046 | rps-16 encodes a small ribosomal subunit S16 protein. | Acute lethal or lethal |
| T01H3.1 | CG7007 | proteolipid protein PPA1 like protein | Acute lethal or lethal |
| T05C12.7 | CG5374 | Cytosolic chaperonin | Acute lethal or lethal |
| T05H4.6 | CG5605 | eukaryotic peptide chain release factor subunit 1 | Acute lethal or lethal |
| T10H9.4 | CG17248 | N-synaptobrevin; v-SNARE, vesicle-mediated transport, synaptic vesicle | |
| T14F9.1 | CG17332 | ATPase subunit | Growth delay or arrested in growth |
| T20G5.1 | CG9012 | Clathrin heavy chain | Acute lethal or lethal |
| T21B10.7 | CG7033 | t-complex protein 1 | Embryonic lethal or sterile |
| W09B12.1 | CG17907 | Acetylcholineesterase | |
| T27F2.1 | CG8264 | Member of the mammalian SKIP (Ski interacting protein) homolog gene class | Acute lethal or lethal |
| ZC434.5 | CG5394 | predicted mitochondrial glutamyl-tRNA synthetase (GluRS) | Acute lethal or lethal |
| B0511.6 | CG6375 | helicase | Embryonic lethal or sterile |
| DY3.2 | CG10119 | Nuclear lamin; LMN-1 protein | Growth delay or arrested in growth |
| R13G10.1 | CG11397 | homolog of the SMC4 subunit of mitotic condensin | Wild Type |
| T26E3.7 | CG3612 | Predicted mitochondrial protein. | Growth delay or arrested in growth |
| Y113G7A.3 | CG1250 | GTPase activator, ER to Golgi prot transport, component of the Golgi stack | Acute lethal or lethal |
| Y43B11AR.4 | CG11276 | Ribosomal protein S4 (RpS4), structural constituent of ribosome involved in protein biosynthesis which is a component of the cytosolic small ribosomal subunit | Acute lethal or lethal |
| Y46G5A.4 | CG5931 | Y46G5A.4 gene | Acute lethal or lethal |
| Y71F9AL.17 | CG7961 | Alpha subunit of the coatomer (COPI) complex | Acute lethal or lethal |
| Y76B12C.7 | CG10110 | Gene cleavage and polyadenylation specificity factor | Embryonic lethal or sterile |
| Y37D8A.10 | CG1751 | Unknown function | Embryonic lethal or sterile |
| CG7765 | C06G3.2 | Member of the Kinesin-Like Protein gene class | |
| CG10922 | C44E4.4 | RNA-binding protein | Embryonic lethal or sterile |
| CG4145 | F01G12.5 | alpha-2 type IV collagen | Embryonic lethal or sterile |
| CG13391 | F28H1.3 | apredicted cytoplasmic alanyl-tRNA synthetase (AlaRS) | Growth delay or arrested in growth |
| CG7765 | R05D3.7 | Member of the UNCoordinated gene class | Embryonic lethal or sterile |
| CG7398 | R06A4.4 | Member of the IMportin Beta family gene class | Embryonic lethal or sterile |
| CG7436 | T17E9.2 | Unknown function | Embryonic lethal or sterile |
| CG2666 | T25G3.2 | putative chitin synthase | Embryonic lethal or sterile |
| CG17603 | W04A8.7 | TATA-binding protein associated factor TAF1L (TAFII250) | Embryonic lethal or sterile |

TABLE 1-LD

| Target ID | Dm identifier | SEQ ID NO NA | SEQ ID NO AA | Function (based on Flybase) |
|---|---|---|---|---|
| LD001 | CG11276 | 1 | 2 | Ribosomal protein S4 (RpS4), structural constituent of ribosome involved in protein biosynthesis which is a component of the cytosolic small ribosomal subunit |
| LD002 | CG8055 | 3 | 4 | Carrier protein with putatively involved in intracellular protein transport |
| LD003 | CG3395 | 5 | 6 | Ribosomal protein S9 (RpS9), structural constituent of ribosome involved in protein biosynthesis which is a component of the cytosolic small ribosomal subunit |
| LD006 | CG3180 | 7 | 8 | RNA polymerase II 140 kD subunit (RpII140), DNA-directed RNA polymerase activity (EC: 2.7.7.6) involved in transcription from Pol II promoter which is a component of the DNA-directed RNA polymerase II, core complex |
| LD007 | CG7269 | 9 | 10 | Helicase at 25E (Hel25E), also known in FlyBase as Dbp25F, Hel, I(2)25Eb and I(2)k11511, pre-mRNA splicing factor activity involved in nuclear mRNA splicing, via spliceosome which is localized to the nucleus |
| LD010 | CG1250 | 11 | 12 | GTPase activator, ER to Golgi prot transport, component of the Golgi stack |
| LD011 | CG1404 | 13 | 14 | Tutative RAN small monomeric GTPase (cell adhesion) |
| LD014 | CG1088 | 15 | 16 | V-ATPase E subunit |
| LD015 | CG2331 | 17 | 18 | Transitional endoplasmic reticulum ATPase TER94, Golgi organization and biogenesis |
| LD016 | CG17369 | 19 | 20 | V-ATPase B subunit |
| LD018 | CG1915 | 21 | 22 | Sallimus (sls), myosin-light-chain kinase activity (EC: 2.7.1.117) involved in mitotic chromosome condensation which is localized to the nucleus |
| LD027 | CG6699 | 23 | 24 | Beta-coatamer protein, subunit of a multimeric complex that forms a membrane vesicle coat |

TABLE 1-PC

| Target ID | Dm identifier | SEQ ID NO NA | SEQ ID NO AA | Function (based on Flybase) |
|---|---|---|---|---|
| PC001 | CG11276 | 247 | 248 | Ribosomal protein S4 (RpS4), structural constituent of ribosome involved in protein biosynthesis which is a component of the cytosolic small ribosomal subunit |
| PC003 | CG3395 | 249 | 250 | Ribosomal protein S9 (RpS9), structural constituent of ribosome involved in protein biosynthesis which is a component of the cytosolic small ribosomal subunit |
| PC005 | CG2746 | 251 | 252 | Ribosomal protein L19, structural constituent of ribosome involved in protein biosynthesis which is localised to the ribosome |
| PC010 | CG1250 | 253 | 254 | GTPase activator, ER to Golgi prot transport, component of the Golgi stack |
| PC014 | CG1088 | 255 | 256 | V-ATPase E subunit |
| PC016 | CG17369 | 257 | 258 | V-ATPase B subunit |
| PC027 | CG6699 | 259 | 260 | Beta-coatamer protein, subunit of a multimeric complex that forms a membrane vesicle coat |

TABLE 1-EV

| Target ID | Dm identifier | SEQ ID NO NA | SEQ ID NO AA | Function (based on Flybase) |
|---|---|---|---|---|
| EV005 | CG2746 | 513 | 514 | Ribosomal protein L19, structural constituent of ribosome involved in protein biosynthesis which is localised to the ribosome |
| EV009 | CG9261 | 515 | 516 | Protein involved with Na+/K+-exchanging ATPase complex |
| EV010 | CG1250 | 517 | 518 | GTPase activator, ER to Golgi prot transport, component of the Golgi stack |
| EV015 | CG2331 | 519 | 520 | Transitional endoplasmic reticulum ATPase TER94, Golgi organization and biogenesis |
| EV016 | CG17369 | 521 | 522 | V-ATPase B subunit |

TABLE 1-AG

| Target ID | Dm identifier | SEQ ID NO NA | SEQ ID NO AA | Function (based on Flybase) |
|---|---|---|---|---|
| AG001 | CG11276 | 601 | 602 | Ribosomal protein S4 (RpS4), structural constituent of ribosome involved in protein biosynthesis which is a component of the cytosolic small ribosomal subunit |
| AG005 | CG2746 | 603 | 604 | Ribosomal protein L19, structural constituent of ribosome involved in protein biosynthesis which is localised to the ribosome |
| AG010 | CG1250 | 605 | 606 | GTPase activator, ER to Golgi prot transport, component of the Golgi stack |
| AG014 | CG1088 | 607 | 608 | V-ATPase E subunit |
| AG016 | CG17369 | 609 | 610 | V-ATPase B subunit |

TABLE 1-TC

| Target ID | Dm identifier | SEQ ID NO NA | SEQ ID NO AA | Function (based on Flybase) |
|---|---|---|---|---|
| TC001 | CG11276 | 793 | 794 | Ribosomal protein S4 (RpS4), structural constituent of ribosome involved in protein biosynthesis which is a component of the cytosolic small ribosomal subunit |

TABLE 1-TC-continued

| Target ID | Dm identifier | SEQ ID NO NA | SEQ ID NO AA | Function (based on Flybase) |
|---|---|---|---|---|
| TC002 | CG8055 | 795 | 796 | Protein with putatively involved in intracellular protein transport |
| TC010 | CG1250 | 797 | 798 | GTPase activator, ER to Golgi prot transport, component of the Golgi stack |
| TC014 | CG1088 | 799 | 800 | V-ATPase E subunit |
| TC015 | CG2331 | 801 | 802 | Transitional endoplasmic reticulum ATPase TER94, Golgi organization and biogenesis |

TABLE 1-MP

| Target ID | Dm identifier | SEQ ID NO NA | SEQ ID NO AA | Function (based on Flybase) |
|---|---|---|---|---|
| MP001 | CG11276 | 888 | 889 | Ribosomal protein S4 (RpS4), structural constituent of ribosome involved in protein biosynthesis which is a component of the cytosolic small ribosomal subunit |
| MP002 | CG8055 | 890 | 891 | Carrier protein with putatively involved in intracellular protein transport |
| MP010 | CG1250 | 892 | 893 | GTPase activator, ER to Golgi prot transport, component of the Golgi stack |
| MP016 | CG17369 | 894 | 895 | V-ATPase B subunit |
| MP027 | CG6699 | 896 | 897 | Beta-coatamer protein, subunit of a multimeric complex that forms a membrane vesicle coat |

TABLE 1-NL

| Target ID | Dm identifier | SEQ ID NO NA | SEQ ID NO AA | Function (based on Flybase) |
|---|---|---|---|---|
| NL001 | CG11276 | 1071 | 1072 | Ribosomal protein S4 (RpS4), structural constituent of ribosome involved in protein biosynthesis which is a component of the cytosolic small ribosomal subunit |
| NL002 | CG8055 | 1073 | 1074 | Protein with putatively involved in intracellular protein transport |
| NL003 | CG3395 | 1075 | 1076 | Ribosomal protein S9 (RpS9), structural constituent of ribosome involved in protein biosynthesis which is a component of the cytosolic small ribosomal subunit |
| NL004 | CG6141 | 1077 | 1078 | Ribosomal protein L9, structural constituent of ribosome involved in protein biosynthesis which is localised to the ribosome |
| NL005 | CG2746 | 1079 | 1080 | Ribosomal protein L19, structural constituent of ribosome involved in protein biosynthesis which is localised to the ribosome |
| NL006 | CG3180 | 1081 | 1082 | RNA polymerase II 140 kD subunit (RpII140), DNA-directed RNA polymerase activity (EC: 2.7.7.6) involved in transcription from Pol II promoter which is a component of the DNA-directed RNA polymerase II, core complex |
| NL007 | CG7269 | 1083 | 1084 | Helicase at 25E (Hel25E), also known in FlyBase as Dbp25F, Hel, l(2)25Eb and l(2)k11511, pre-mRNA splicing factor activity involved in nuclear mRNA splicing, via spliceosome which is localized to the nucleus |
| NL008 | CG3416 | 1085 | 1086 | Protein with endopeptidase activity involved in proteolysis and peptidolysis which is a component of the proteasome regulatory particle, lid subcomplex (sensu Eukarya) |
| NL009 | CG9261 | 1087 | 1088 | Protein involved with Na+/K+-exchanging ATPase complex |
| NL010 | CG1250 | 1089 | 1090 | GTPase activator, ER to Golgi prot transport, component of the Golgi stack |
| NL011 | CG1404 | 1091 | 1092 | Putative RAN small monomeric GTPase (cell adhesion) |
| NL012 | CG17248 | 1093 | 1094 | N-synaptobrevin; v-SNARE, vesicle-mediated transport, synaptic vesicle |
| NL013 | CG18174 | 1095 | 1096 | Putative proteasome regulatory particle, lid subcomplex, rpn11 |
| NL014 | CG1088 | 1097 | 1098 | V-ATPase E subunit |
| NL015 | CG2331 | 1099 | 1100 | Transitional endoplasmic reticulum ATPase TER94, Golgi organization and biogenesis |
| NL016 | CG17369 | 1101 | 1102 | V-ATPase B subunit |
| NL018 | CG1915 | 1103 | 1104 | Sallimus (sls), myosin-light-chain kinase activity (EC: 2.7.1.117) involved in mitotic chromosome condensation which is localized to the nucleus |
| NL019 | CG3320 | 1105 | 1106 | Rab-protein 1 involved in cell adhesion |
| NL021 | CG10110 | 1107 | 1108 | Gene cleavage and polyadenylation specificity factor |
| NL022 | CG10689 | 1109 | 1110 | Product with RNA helicase activity (EC: 2.7.7.—) involved in nuclear mRNA splicing, via spliceosome which is a component of the spliceosome complex |
| NL023 | CG17907 | 1111 | 1112 | Acetylcholineesterase |
| NL027 | CG6699 | 1113 | 1114 | Beta-coatamer protein |

TABLE 1-CS

| Target ID | Dm identifier | SEQ ID NO NA | SEQ ID NO AA | Function (based on Flybase) |
|---|---|---|---|---|
| CS001 | CG11276 | 1682 | 1683 | Ribosomal protein S4 (RpS4), structural constituent of ribosome involved in protein biosynthesis which is a component of the cytosolic small ribosomal subunit |
| CS002 | CG8055 | 1684 | 1685 | Carrier protein with putatively involved in intracellular protein transport |
| CS003 | CG3395 | 1686 | 1687 | Ribosomal protein S9 (RpS9), structural constituent of ribosome involved in protein biosynthesis which is a component of the cytosolic small ribosomal subunit |
| CS006 | CG3180 | 1688 | 1689 | RNA polymerase II 140 kD subunit (RpII140), DNA-directed RNA polymerase activity (EC: 2.7.7.6) involved in transcription from Pol II promoter which is a component of the DNA-directed RNA polymerase II, core complex |

TABLE 1-CS-continued

| Target ID | Dm identifier | SEQ ID NO NA | SEQ ID NO AA | Function (based on Flybase) |
|---|---|---|---|---|
| CS007 | CG7269 | 1690 | 1691 | Helicase at 25E (Hel25E), also known in FlyBase as Dbp25F, Hel, I(2)25Eb and I(2)k11511, pre-mRNA splicing factor activity involved in nuclear mRNA splicing, via spliceosome which is localized to the nucleus |
| CS009 | CG9261 | 1692 | 1693 | Protein involved with Na+/K+-exchanging ATPase complex |
| CS011 | CG1404 | 1694 | 1695 | Tutative RAN small monomeric GTPase (cell adhesion) |
| CS013 | CG18174 | 1696 | 1697 | Putative proteasome regulatory particle, lid subcomplex, rpn11 |
| CS014 | CG1088 | 1698 | 1699 | V-ATPase E subunit |
| CS015 | CG2331 | 1700 | 1701 | Transitional endoplasmic reticulum ATPase TER94, Golgi organization and biogenesis |
| CS016 | CG17369 | 1702 | 1703 | V-ATPase B subunit |
| CS018 | CG1915 | 1704 | 1705 | Sallimus (sls), myosin-light-chain kinase activity (EC: 2.7.1.117) involved in mitotic chromosome condensation which is localized to the nucleus |

TABLE 1-PX

| Target ID | Dm identifier | SEQ ID NO NA | SEQ ID NO AA | Function (based on Flybase) |
|---|---|---|---|---|
| PX001 | CG11276 | 2100 | 2101 | Ribosomal protein S4 (RpS4), structural constituent of ribosome involved in protein biosynthesis which is a component of the cytosolic small ribosomal subunit |
| PX009 | CG9261 | 2102 | 2103 | Protein involved with Na+/K+-exchanging ATPase complex |
| PX010 | CG1250 | 2104 | 2105 | GTPase activator, ER to Golgi prot transport, component of the Golgi stack |
| PX015 | CG2331 | 2106 | 2107 | Transitional endoplasmic reticulum ATPase TER94, Golgi organization and biogenesis |
| PX016 | CG17369 | 2108 | 2109 | V-ATPase B subunit |

TABLE 1-AD

| Target ID | Dm identifier | SEQ ID NO NA | SEQ ID NO AA | Function (based on Flybase) |
|---|---|---|---|---|
| AD001 | CG11276 | 2364 | 2365 | Ribosomal protein S4 (RpS4), structural constituent of ribosome involved in protein biosynthesis which is a component of the cytosolic small ribosomal subunit |
| AD002 | CG8055 | 2366 | 2367 | Carrier protein with putatively involved in intracellular protein transport |
| AD009 | CG9261 | 2368 | 2369 | Protein involved with Na+/K+-exchanging ATPase complex |
| AD015 | CG2331 | 2370 | 2371 | Transitional endoplasmic reticulum ATPase TER94, Golgi organization and biogenesis |
| AD016 | CG17369 | 2372 | 2373 | V-ATPase B subunit |

TABLE 2-LD

| Target ID | Primer Forward 5' → 3' | Primer Reverse 5' → 3' | cDNA Sequence (sense strand) 5' → 3' |
|---|---|---|---|
| LD001 | SEQ ID NO: 25 GGCCCCAAGAA GCATTTGAAGC G | SEQ ID NO: 26 TAGCGGATGGT GCGDCCRTCRT G | SEQ ID NO: 1 GGCCCCAAGAAGCATTTGAAGCGTTTGAATGCCCCAAAAGCATGGATGTTGGATAAATTGG GAGGTGTTTTCGCACCTCGCCCATCTACAGGACCTCACAAATTGCGAGAGTCTTTGCCCTT GGTGATCTTCCTACGTAACCGATTGAAGTATGCTTTGACTAACAGCGAAGTTACTAAGATTG TTATGCAAAGGTTAATCAAAGTAGATGGAAAAGTGAGGACCGACTCCAATTACCCTGCTGG GTTTATGGATGTTATTACCATTGAAAAAACTGGTGAATTTTTCCGACTCATCTATGATGTTAA AGGACGATTTGCAGTGCATCGTATTACTGCTGAGGAAGCAAAGTACAAACTATGCAAAGTC AGGAGGATGCAAACTGGCCCCAAAGGAATTCCCTTCATAGTGACACACGACGGCCGCACC ATCCGCTA |
| LD002 | SEQ ID NO: 27 GAGCGGCCAT GCAAGCVCTBA ARMRRAAG | SEQ ID NO: 28 GCAATGTCATC CATCAKRTCRT GCAC | SEQ ID NO: 3 GCAATGTCATCCATCATGTCGTGTACATTGTCCACGTCCAAGTTTTTATGGGCTTTCTTAAG AGCTTCAGCTGCATTTTTCATAGATTCCAATACTGTGGTGTTCGTACTAGCTCCCTCCAGAG CTTCTCGTTGAAGTTCAATAGTAGTTAAAGTGCCATCTATTTGCAACTGATTTTTTTCTAATC GCTTCTTCCGCTTCAGCGCTTGCATGGCCGCTC |
| LD003 | SEQ ID NO: 29 TCGGTCTTCTC GAAGACNTAYG TKAC | SEQ ID NO: 30 CAGGTTCTTCC TCTTKACRCGD CC | SEQ ID NO: 5 CAGGTTCTTCCTCTTGACGCGTCCAGGGCGACCACCACCGAATGGAGATTTGAGCGAGAA GTCAATATGCTTCTGGGAATCAAGTCTCACAATGAAGCTTGGAATATTCACGACCTGCTTAC GAACCCTGATATGTCTTTGACGGACCAGCACACGAGCATGATGGATTGATTTTGCAAGCCC CAACTTGAAAACTTGTGTTTGGAGACGTCGTTCCAAGAAATCTTCAATCTTCAAACCCAAGA CGTAATCAAGCTTCATACGGGTTTCATCCAACACTCCAATACGCACCAACCGACGAAGAAG AGCATTGCCTTCAAACAACCTGCGCTGATCTTTCTCTTCCAAAGTCAGAAGTTCTCTGGCAG CTTTACGGATTTTTGCCAAGGTATACTTGACTCGCCACACTTCACGTTTGTTCCTAAGACCA TATTCTCCTATGATTTTCAACTCCTGATCAAGACGTGCCTTTTCATAAGGTCGCTGGGA |

TABLE 2-LD-continued

| Target ID | Primer Forward 5' → 3' | Primer Reverse 5' → 3' | cDNA Sequence (sense strand) 5' → 3' |
|---|---|---|---|
| LD006 | SEQ ID NO: 31 GGAGCGAGAC TACAACAAYKA YRGYTGGC | SEQ ID NO: 32 CTCGAACTGCT CYTCYTGATCR CC | SEQ ID NO: 7 GGAGCGAGACTACAACAACTATGGCTGGCAGGTGTTGGTTGCTTCTGGTGTGGTGGAATAC ATCGACACTCTTGAAGAAGAAACTGTCATGATTGCGATGAATCCTGAGGATCTTCGGCAGG ACAAAGAATATGCTTATTGTACGACCTACACCCACTGCGAAATCCACCCGGCCATGATCTT GGGCGTTTGCGCGTCTATTATACCTTTCCCCGATCATAACCAGAGCCCAAGGAACACCTAC CAGAGCGCTATGGGTAAGCAAGCTATGGGGGTCTACATTACGAATTTCCACGTGCGGATG GACACCCTGGCCCACGTGCTATACTACCCGCACAAACCTCTGGTCACTACCAGGTCTATG GAGTATCTGCGGTTCAGAGAATTACCAGCCGGGATCAACAGTATAGTTGCTATTGTTGTT ATACTGGTTATAATCAAGAAGATTCTGTTATTCTGAACGCGTCTGCTGTGGAAAGAGGATTT TTCCGATCCGTGTTTTATCGTTCCTATAAAGATGCCGAATCGAAGCGAATTGGCGATCAAG AAGAGCAGTTCGAG |
| LD007 | SEQ ID NO: 33 CCGAAGAAGGA YGTSAAGGGYA C | SEQ ID NO: 34 CGATGCAAGTA GGTGTGTCKGART CYTC | SEQ ID NO: 9 CCGAAGAAGGATGTGAAGGGTACTTACGTATCCATACACAGTTCAGGCTTCAGAGATTTTT TATTGAAACCAGAAATTCTAAGAGCTATAGTTGACTGCGGTTTTGAACACCCTTCAGAAGTT CAGCACGAATGTATTCCTCAAGCTGTCATTGGCATGGACATTTTATGTCAAGCCAAATCTGG TATGGGCAAAACGGCAGTGTTTGTTCTGGCGACACTGCAACAATTGGAACCAGCGGACAAT GTTGTTTACGTTTTGGTGATGTGTCACACTCGTGAACTGGCTTTCCAAATCAGCAAAGAGTA CGAGAGGTTCAGTAAATATATGCCCAGTGTCAAGGTGGGCGTCTTTTTCGGAGGAATGCCT ATTGCTAACGATGAAGAAGTATTGAAAAACAAATGTCCACACATTGTTGTGGGGACGCCTG GGCGTATTTTGGCGCTTGTCAAGTCTAGGAAGCTAGTCCTCAAGAAGTCTGAAACACTTCAT TCTTGATGAGTGCGATAAAATGTTAGAACTGTTGGATATGAGGAGAGACGTCCAGGAAATC TACAGAAACACCCCTCACACCAAGCAAGTGATGATGTTCAGTGCCACACTCAGCAAAGAAA TCAGGCCGGTGTGCAAGAAATTCATGCAAGATCCAATGGAGGTGTATGTAGACGATGAAG CCAAATTGACGTTGCACGGATTACAACAGCATTACGTTAAACTCAAAGAAAATGAAAAGAAT AAAAAATTATTTGAGTTGCTCGATGTTCTCGAATTTAATCAGGTGGTCATTTTTGTGAAGTCC GTTCAAAGGTGTGTGGCTTTGGCACAGTTGCTGACTGAACAGAATTTCCCAGCCATAGGAA TTCACAGAGGAATGGACCAGAAAGAGAGGTTGTCTCGGTATGAGCAGTTCAAAGATTTCCA GAAGAGAATATTGGTAGCTACGAATCTCTTTGGGCGTGGCATGGACATTGAAAGGGTCAAC ATTGTCTTCAACTATGATATGCCAGAGGACTCCGACACCTACTTGCATCG |
| LD010 | SEQ ID NO: 35 CTCTCAAGGAT TCKYTRCARAT GTC | SEQ ID NO: 36 CGCCATTGGGC RATGGTYTCKC C | SEQ ID NO: 11 CTCTCAAGGATTCGTGCAGATGTCTTTGAGCTTGTTGCCCCCGAATGCCTTGATAGGGTT GATTACCTTTGGGAAGATGGTCCAAGTGCACGAACTAGGTACCGAGGGCTGCAGCAAATC TTACGTTTTCCGAGGGACGAAAGACCTCACAGCTAAGCAAGTTCAAGAGATGTTGGAAGTG GGCAGAGCCGCAGTAAGTGCTCAACCTGCTCCTCAACAACCAGGACAACCCATGAGGCCT GGAGCACTCCAGCAAGCTCCTACGCCACCAGGAAGCAGGTTCCTTCAACCCATCTCGAAA TGCGACATGAACCTCACTGATCTTATTGGAGAGTTGCAAAGAGACCCATGGCCTGTCCACC AAGGCAAATGCGCCCTTAGATCGACCGGGACAGCTTTATCGATAGCCATTGGGTTGTTGGA GTGCACATACGCCAATACTGGTGCCAGGGTCATGCTATTCGTTGAGGACCTTGCTCTCAA GGCCCTGGTCAAGTCTTGAATGATGATCTGAAGCAACCTATCAGATCTCACCACGACATCC AAAAAGACAATGCCAAATACATGAAGAAAGCAATCAACGCACTATGATAATTTAGCGATGAGA GCAGCAACGAATGGCCACTGCGTTGACATATATTCATGCGCTTTGGATCAGACAGGATTGA TGGAGATGAAACAGTGTTGTAATTCAACAGGGGACATATGGTCATGGGCGACTCGTTCAA TTCTTCCCTGTTCAAGCAAACGTTCCAGCGCATATTTTCGAAAGATCAGAAAAACGAGCTGA AGATGGCATTTAATGGTACTCTGGAGGGTCAAGTGTTCCAGGGAGTTGAAAATTCAAGGCG GTATTGGATCTTGTGTTTCGTTGAATGTGAAGAATCCTTTGGTTTCCGACACCGAAATAGGA ATGGGTAACACGGTCCAGTGGAAATGTGTACGGTAACTCCAAGTACTACCATGGCCTTGT TCTTCGAGGTCGTCAACCAACATTCCGCTCCCATACCTCAAGGGGGAAGGGCTGCATAC AGTTCATCACGCAATATCAGCATGCTAGTGGCCAGAAGAGGATCCGAGTAACGACAGTTGC TAGAAACTGGGCCGATGCTTCCGCTAATACACATCATGTCAGTGCTGGATTCGATCAGGAG GCAGCCGCAGTGATAATGGCGAGGATGGCAGTTTACAGAGCGGAATCAGACGATAGCCCT GATGTTTTGAGATGGGTCGATAGGATGTTGATACGTCTGTGCCAGAAATTCGGCGAATATA ACAAGGACGACCCGAATTCGTTCCGCTTGGGCGAAAACTTCAGCCTCTACCCGCAGTTCAT GTACCATTTGAGAAGGTCACAGTTCCTGCAGGTGTTTAACAATTCTCCCGACGAAACGTCC TTCTACAGGCACATGCTTATGCGCGAAGACCTCACGCAGTCGCTGATCATGATCCAGCCGA TACTCTACAGCTACAGTTTCAATGGACCACCAGAACCTGTGCTTTTGGATACGAGTTCCATC CAACCCGATAGAATTCTGCTCATGGACACGTTCTTCCAGATTCTGATATTCCATGGCGAAAC CATCGCCCAATGGCG |
| LD011 | SEQ ID NO: 37 CCCACTTTCAA GTGYGTRTYTRG TCGG | SEQ ID NO: 38 GTGGAAGCAG GGCWGGCATK GCRAC | SEQ ID NO: 13 GTGGAAGCAGGGCTGGCATGGCGACAAATTCTAGATTGGGATCACCAATAAGCTTCCTAG CTAGCCATAGGAAAGGCTTCTCAAAGTTGTGGTTAGATTTGGCAGAGATATCATAGTACTGC AAATTCTTCTTCCTATGAAAGACAATACTTTTCGCTTTTACTTTTCTGTCTTTGATGTCAACCT TGTTCCCGCAAAGTACTATCGGGTATATTTCACAGACTCTGACAAGATCTCTGTGCCAATTT GGTACATTCTTGTATGTAACTCTGGAAGTTACATCAAACATGATAATAGCACACTGTCCCTG AATGTAATATCCATCACGGAGACCACCAAACTTCTCCTGACCGCAGTGTCCCATACATTG AACCGAATAGGGCCCCTGTTTGTATGGAAGACCAGAGGATGGACTTCAACTCCCAAAGTAG CTACATATCTTTTTTCAAATTCACCAGTCATATGACGTTTCACAAATGTCGTTTTTCCAGTAC CTCCATCTCCGACCAACACACACTTGAAAGTGGG |
| LD014 | SEQ ID NO: 39 CGCAGATCAAR CAYATGATGGC | SEQ ID NO: 40 CGGATCTCGG GCASMARYTGC | SEQ ID NO: 15 CGCAGATCAAGCATATGATGGCTTTCATTGAACAAGAGGCAAACGAAAGGCAGAAGAAAT CGATGCCAAGGCCGAGGAAGAATTTAATATTGAAAGGGGCGCCTTGTTCAGCAACAACGT CTCAAGATTATGGAATATTATGAGAAGAAAGAGAAACAGGTCGAACTCCAGAAAAAAATCCA ATCGTCTAACATGTTGAATCAGGCTCGATTGAAAGTATTGAAGGTTAGGGAAGATCACGTT |

TABLE 2-LD-continued

| Target ID | Primer Forward 5' → 3' | Primer Reverse 5' → 3' | cDNA Sequence (sense strand) 5' → 3' |
|---|---|---|---|
| | | | CGTACCGTACTAGAGGAGGCGCGTAAACGACTTGGTCAGGTCACAAACGACCAGGGAAAA<br>TATTCCCAAATCCTGGAAAGCCTCATTTTGCAGGGATTATATCAGCTTTTTGAGAAAGATGT<br>TACCATTCGAGTTCGGCCCCAGGACCGAGAACTGGTCAAATCCATCATTCCCACCGTCACG<br>AACAAGTATAAAGATGCCACCGGTAAGGACATCCATCTGAAAATTGATGACGAAATCCATCT<br>GTCCCAAGAAACCACCGGGGGAATCGACCTGCTGGCGCAGAAAAACAAATCAAGATCAG<br>CAATACTATGGAGGCTCGTCTGGAGCTGATTTCGCAGCAACTTCTGCCCGAGATCCG |
| LD014_F1 | | | SEQ ID NO: 159<br>TCTAGAATGTTGAATCAGGCTCGATTGAAAGTATTGAAGGTTAGGGAAGATCACGTTCGTA<br>CCGTACTAGAGGAGGCGCGTAAACGACTTGGTCAGGTCACAAACGCCCGGG |
| LD014_F2 | | | SEQ ID NO: 160<br>TCTAGAAAGATCACGTTCGTACCGTACTAGAGGAGGCGCGTAAACGACTTGGTCAGGTCA<br>CAAACGCCCGGG |
| LD014_C1 | | | SEQ ID NO: 161<br>TCTAGAATGTTGAATCAGGCTCGATTGAAAGTATTGAAGGTTAGGGAAGATCACGTTCGTA<br>CCGTACTAGAGGAGGCGCGTAAACGACTTGGTCAGGTCACAAACGATGTTGAATCAGGCT<br>CGATTGAAAGTATTGAAGGTTAGGGAAGATCACGTTCGTACCGTACTAGAGGAGGCGCGT<br>AAACGACTTGGTCAGGTCACAAACGATGTTGAATCAGGCTCGATTGAAAGTATTGAAGGTT<br>AGGGAAGATCACGTTCGTACCGTACTAGAGGAGGCGCGTAAACGACTTGGTCAGGTCACA<br>AACGCCCGGG |
| LD014_C2 | | | SEQ ID NO: 162<br>TCTAGAAAGATCACGTTCGTACCGTACTAGAGGAGGCGCGTAAACGACTTGGTCAGGTCA<br>CAAACGAAGATCACGTTCGTACCGTACTAGAGGAGGCGCGTAAACGACTTGGTCAGGTCA<br>CAAACGAAGATCACGTTCGTACCGTACTAGAGGAGGCGCGTAAACGACTTGGTCAGGTCA<br>CAAACGAAGATCACGTTCGTACCGTACTAGAGGAGGCGCGTAAACGACTTGGTCAGGTCA<br>CAAACGAAGATCACGTTCGTACCGTACTAGAGGAGGCGCGTAAACGACTTGGTCAGGTCA<br>CAAACGCCCGGG |
| LD015 | SEQ ID NO: 41<br>CGCCATCCRTC<br>GCTSTTCAAGG<br>C | SEQ ID NO: 42<br>GCAATGGCATC<br>AAKYTCRTCRA<br>TG | SEQ ID NO: 17<br>GCAATGGCATCAAGTTCATCGATGAAGATGATCGCCGGAGAGTTTTTGTCAGCTTCTTCAA<br>AAGCTTTGCGCAAGTTACTCTCAGACTCGCCAGCGAGTTTGCTCATGATCTCCGGCCCGTT<br>TATCAAGAAGAAGAACGCCCCAGTCTCATTAGCCACGGCGCGAGCAATCAGGGTCTTACC<br>CGTACCAGGGGGACCATACAGCAGTATACCCCTAGGGGGCTTCACGCCGATAGCCTTGAA<br>GAGCGATGGATGGCG |
| LD016 | SEQ ID NO: 43<br>GACTGTGTCTG<br>GTGTRAACGG<br>WCC | SEQ ID NO: 44<br>GGAATAGGATG<br>GGTRATRTCGT<br>CG | SEQ ID NO: 19<br>GGAATAGGATGGGTAATGTCGTCGTTGGGCATAGTCAATATAGGAATCTGGGTGATGGATC<br>CGTTACGTCCTTCAACACGGCCGGCACGTTCATAGATGGTAGCTAAATCGGTGTACATGTA<br>ACCTGGGAAACCACGACGACCAGGCACCTCTTCTCTGGCAGCAGATACCTCACGCAAAGC<br>TTCTGCATACGAAGACATATCTGTCAAGATGACCAAGACGTGCTTCTCACATTGGTAAGCC<br>AAGAATTCGGCAGCTGTCAAAGCCAGACGAGGTGTAATAATTCTTTCAATGGTAGGATCGT<br>TGGCCAAATTCAAGAACAGGCAGACATTCTCCATAGAACCGTTCTCTTGAAATCCTGTTTG<br>AAGAACCTAGCTGTTTCCATGTTAACACCCATAGCAGCGAAAACAATAGCAAAGTTATCTTC<br>ATGATCATCAAGTACAGATTTACCAGGAATCTTGACTAAACCAGCCTGTCTACAGATCTGGG<br>CAGCAATTTCATTGTGAGGCAGACCAGCTGCAGAGAAAATGGGGATCTTCTGACCACGAG<br>CAATGGAGTTCATCACGTCAATAGCTGTAATACCCGTCTGGATCATTTCCTCAGGATAGATA<br>CGGGACCACGGATTGATTGGTTGACCCTGGATGTCCAAGAAGTCTTCAGCCAAAATTGGG<br>GGACCTTTGTCGATGGGTTTTCCTGATCCATTGAAAACACGTCCCAACATATCTTCAGAAAC<br>AGGAGTCCTCAAAATATCTCCTGTGAATTCACAAGCGGTGTTTTGGCGTCGATTCCTGAT<br>GTGCCCTCGAACACTTGAACCACAGCTTTTGACCCACTGACTTCCAGAACTTGTCCCGAAC<br>GTATAGTGCCATCAGCCAGTTTGAGTTGTACGATTTCATTGTACTTGGGGAACTTAACATCT<br>TCGAGGATTACCAGAGGACCGTTCACACCAGACACAGTC |
| LD018 | SEQ ID NO: 45<br>CACCTGGTTCA<br>AGRATGGVCAR<br>MG | SEQ ID NO: 46<br>GTGCATCGGTA<br>CCAHSCHGCRT<br>C | SEQ ID NO: 21<br>CACCTGGTTCAAGGATGGGCAGCGGATAACGGAGTCGCAGAAATACGAGAGCACCTTCTC<br>GAACAACCAAGCCTCCTTGAGGGTAAAACAAGCCCAGTCTGAGGACTCGGGACACTACAC<br>TTTGTTGGCGGAGAACCTCAAGGCTGCATAGTGTCATCTGCTTACTTAGCCATAGAACCG<br>GTAACCACCCAGGAAGGGTTGATCCACGAGTCCACCTTCAAGCAGCAACAGACCGAAATG<br>GAGCAAATCGACACCAGCAAGACCTTGGCGCCTAACTTCGTCAGGGTTTGCGGGATAGA<br>GACGTGACCGAGGGCAAGATGACCCGCTTCGACTGTCGCGTCACTGGTCGTCCTTATCCA<br>GACGTGACATGGTACATAAACGGTCGACAAGTCACCGACGACCACAACCACAAGATTTTGG<br>TTAACGAATCCGGAAACCATGCCCTGATGATCACCACCGTGAGCAGGAACGACTCAGGAG<br>TAGTGACCTGCGTCGCCAGGAACAAGACGGGAGAAACCTCCTTCCAGTGCAACCTTAACG<br>TCATCGAAAGGAACAGGTAGTCGCGCCCAAGTTCGTGGAGAGATTTACCACAGTCAACGT<br>GGCAGAAGGAGAACCAGTGTCTCTGCGCGCTAGAGCTGTTGGCACGCGGTGCCGCGAA<br>TCACTTGGCAGAGGGACGGGGCGCCCCTAGCCAGCGGGCCCGACGTTCGCATCGCGATT<br>GACGGTGGAGCCTCTACTTTGAATATCTCGAGGGCCAAGGCCTCGGATGCTGCATGGTAC<br>CGATGCAC |
| LD027 | SEQ ID NO: 47<br>CCATGGTGGC<br>GAYAARCCVTA<br>C | SEQ ID NO: 48<br>GGTATAGATGA<br>ARCARTCDCCV<br>ACCCA | SEQ ID NO: 23<br>CCATGGTGGCGATAAACCATACTTGATATCGGGAGCAGACGATCGGTTGGTTAAAATCTGG<br>GACTATCAAAACAAAACGTGTGTCCAAACCTTGGAAGGACACGCCCAAAACGTAACCGCG<br>GTTTGTTTCCACCCTGAACTACCTGTGGCTCTCACAGGCAGCGAAGATGGTACCGTTAGAG<br>TTTGGCATACGAATACACACAGATTAGAGAATTGTTTGAATTATGGGTTCGAGAGAGTGTG |

TABLE 2-LD-continued

| Target ID | Primer Forward 5' → 3' | Primer Reverse 5' → 3' | cDNA Sequence (sense strand) 5' → 3' |
|---|---|---|---|
| | | | GACCATTTGTTGCTTGAAGGGTTCGAATAATGTTTCTCTGGGGTATGACGAGGGCAGTATA TTAGTGAAAGTTGGAAGAGAAGAACCGGCAGTTAGTATGGATGCCAGTGGCGGTAAAATAA TTTGGGCAAGGCACTCGGAATTACAACAAGCTAATTTGAAGGCGCTGCCAGAAGGTGGAG AAATAAGAGATGGGGAGCGTTTACCTGTCTCTGTAAAAGATATGGGAGCATGTGAAATATA CCCTCAAACAATCCAACATAATCCGAATGGAAGATTCGTTGTAGTATGCGGAGACGGCGAA TATATCATTTACACAGCGATGGCTCTACGGAACAAGGCTTTTGGAAGCGCTCAAGAGTTTG TCTGGGCTCAGGACTCCAGCGAGTATGCCATTCGCGAGTCTGGTTCCACAATTCGGATATT CAAAAACTTCAAAGAAAGGAAGAACTTCAAGTCGGATTTCAGCGCGGAAGGAATCTACGGG GGTTTTCTCTTGGGGATTAAATCGGTGTCCGGTTTAACGTTTTACGATTGGGAACTTTGGA CTTGGTGAGACGGATTGAAATACAACCGAGGGCGGTTTATTGGTCTGACAGTGGAAAATTA GTCTGTCTCGCAACGGAGGACAGCTACTTCATCCTTTCTTATGATTCGGAGCAAGTTCAGA AGGCCAGGGAGAACAATCAAGTCGCAGAGGATGGCGTAGAGGCCGCTTTCGATGTGTTGG GGGAAATGAACGAGTCTGTCCGAACAGGTCTTTGGGTCGGAGACTGTTTCATCTATACC |

TABLE 2-PC

| Target ID | Primer Forward 5' → 3' | Primer Reverse 5' → 3' | cDNA Sequence (sense strand) 5' → 3' |
|---|---|---|---|
| PC001 | SEQ ID NO: 261 CATTTGAAGCG TTTWRMYGCY CC | SEQ ID NO: 262 CTTCGTGCCCT TGCCRATKATR AABACG | SEQ ID NO: 247 CATTTGAAGCGTTTAGCTGCTCCCAAAGCATGGATGTTGGACAAATTGGGGGGTGTCTTCGCCC CTCGTCCATCCACCGGGCCTCACAAGTTGCGCGAATCCCTGCCTTTAGTGATTTTCCTTCGTAAC AGGCTGAAGTATGCCCTTACAAACAGTGAAGTCACTAAAATTGTCATGCAAAGGTTGATCAAAGT TGATGGTAAAGTGAGGACTGATTCTAATTACCCTGCTGGTTTCATGGATGTCATTACTATTGAGAA GACTGGTGAATTTTTCCGTCTGATCTATGATGTTAAAGGAAGATTTGCTGTGCACCGTATTACAGC TGAAGAGGCAAAATACAAGTTGTGTAAAGTAAGGAGAGTCCAAACTGGTCCCAAAGGAATCCCAT TTTTGGTAACACATGATGGCAGAACCATTCGTTACCCTGACCCCAACATCAAAGTGAATGACACA ATTCAAATGGAAATTGCTACATCTAAAAATTCTTGACTACATCAAATTTGAATCTGGCAACCTCTGC ATGATCACGGGGAGG |
| PC003 | SEQ ID NO: 263 TCGGTCTTCTC GAAGACNTAYG TKAC | SEQ ID NO: 264 CCCTGGTTCTT CTTVRRRTTCT TCCTC | SEQ ID NO: 249 CCCTAGACGTCCCTATGAAAAGGCCCGTCTGGATCAGGAATTGAAAATTATCGGCGCCTTTGGTT TACGAAACAAACGTGAAGTGTGGAGAGTAAAGTACACTTTGGCTAAAATCCGTAAAGCTGCTCGT GAACTGCTCACCCTAGAAGAAAAGAGCCTAAAAGATTGTTTGAAGGTAATGCACTTCTACGTCG TTTGGTGCGAATTGGTGTTCTGGATGAGAACAGGATGAAGCTTGATTATGTTTGGGTCTGAAAA TTGAAGATTTCTTGGAAAGAAGGCTCCAAACTCAGGTGTTCAAATCTGGTCTGGCAAAGTCAATT CATCATGCTAGAGTACTGATTAGGCAGAGACACATCCGGGTGCGCAAGCAGGTGGTGAACATCC CCTCGTTCATCGTGCGGCTGGACTCGCAGAAGCACATCGACTTCTCCCTGAAGTCGCCCTTCGG GGGTGGCCGACCTGGCCGTGTCAA |
| PC005 | SEQ ID NO: 265 TGCGATGCGG CAARAARAAGG TBTGG | SEQ ID NO: 266 TCCTGCTTCTT SGYRGCRATW CGYTC | SEQ ID NO: 251 TGCGATGCGGCAAAAAGAAGGTGTGGTTGGATCCAAATGAAATCAACGAAATCGCCAACACCAA CTCAAGACAAAACATCCGTAAGCTCATCAAGGATGGTCTTATCATCAAGAAGCCAGTGGCAGTAC ACTCTAGGGCCCGTGTACGCAAGAACACTGAAGCCAGAAGGAAGGGAAGGCATTGTGGATTTG GAAAGAGGAAGGTACGGCAAATGCCCGTATGCCTCAAAAGGAACTGTGGGTGCAGCGCATGC GCGTCCTCAGGCGCCTCCTCAAAAAGTACAGGGAGGCCAAGAAAATCGACCGCCATCTTTACCA CGCCCTGTACATGAAAGCGAAGGGTAACGTGTTCAGGAACAAGAGGGTCCTTATGGAGTACATC CACAAGAAGAAGGCAGAGAAGGCCAGGGCCAAGATGCTGTCTGACCAGGCTAACGCCAGGAGA TTGAAGGTGAAGCAGGCCAGGGAACGTAGGGAAGAGCGTATCGCCACCAAGAAGCAGG |
| PC010 | SEQ ID NO: 267 CTCTCAAGGAT TCKYTRCARAT GTC | SEQ ID NO: 268 CGCCATTGGG CRATGGYTCK CC | SEQ ID NO: 253 CTCTCAAGGATTCTTTGCAGATGTCGCTCAGCCTATTACCGCCCAACGCGTTGATTGGATTGATC ACGTTCGGAAAATGGTGCAAGTCCACGAACTGGGTACCGAAGGCTGCAGCAAGTCGTACGTGT TCTGTGGAACGAAAGATCTCACCGCCAAGCAAGTCCAGGAGATGTTGGGCATTGGAAAAGGGTC ACCAAATCCCCAACAACAGCCAGGGCAACCTGGGCGGCCAGGGCAGAATCCCCAAGCTGCCCC TGTACCACCGGGGAGCAGATTCTTGCAGCCCGTGTCAAAATGCGACATGAACTTGACAGATCTG ATCGGGGAGTTGCAGAAAGACCCTTGGCCCGTACATCAGGGCAAAAGACCTCTTAGATCCACAG GCGCAGCATTGTCCATCGCTGTCGGCCTCTTAGAATGCACCTATCCGAATACGGGTGGCAGAAT CATGATATTCTTAGGAGGACCATGCTCTCAGGGTCCCGGCCAGGTGTTAACGACGATTTGAAG CAGCCCATCAGGTCCCATCATGACATACACAAAGACAATGCCAAGTACATGAAGAAGGCTATCAA ACATTACGATCACTTGGCAATGCGATGCTGCCACCAACAGCCATTGCATCGACATTTACTCCTGCG CCCTGGATCAGACGGGACTGATGGAGATGAAGCAGTGCTGCAATTCCACCGGAGGGCACATGG TCATGGGCGATTCCTTCAATTCCTCTCTATTCAAACAAACCTTCCAGCGAGTGTTCTCAAAAGACC CGAAGAACGACCTCAAGATGGCGTTCAACGCCACCTTGGAGGTGAAGTGTTCCAGGGAGTTAAA AGTCCAAGGGGGCATCGGCTCGTGCGTGCTCCTTGAACGTTAAAGCCCTCTGGTTTCGATACG GAACTAGGCATGGGAATACTGTGCAGTGGAAACTTTGCAGTTGGCGCCGAGCTCTACTGTGG CGCTGTTCTTCGAGGTGGTTAACCAGCATTCGGCGCCCATACCACAGGGAGGCAGGGGCTGCA TCCAGCTCATCACCCAGTATCAGCACGCGAGCGGGCAAAGGAGGATCAGAGTGACCACGATTG CTAGAAATTGGGCGGACGTACTGCCAACATCCACCACATTAGCGCTGCGTGCTGTGCTTGATGCG GGCGGCAGTTGTGATGGCCCGAATGGCCGGTTACAAAGGCGGAATCGGACGAGACTCCCGACGT GCTCAGATGGGTGGACAGGATGTTGATCAGGCTGTGCCAGAAGTTCGGAGAGTACAATAAAGAC GATCCGAATTCGTTCAGGTTGGGGGAGAACTTCAGTCTGTATCCGCAGTTCATGTACCATTTGAG ACGGTCGCAGTTTCTGCAGGTGTTCAATAATTCTCCTGATGAAACGTCGTTTTATAGGCACATGC TGATGCGTGAGGATTTGACTCAGTCTTTGATCATGATCCAGCCGATTTTGTACAGTTACAGCTTCA |

TABLE 2-PC-continued

| Target ID | Primer Forward 5' → 3' | Primer Reverse 5' → 3' | cDNA Sequence (sense strand) 5' → 3' |
|---|---|---|---|
| | | | ACGGGCCGCCCGAGCCTGTGTTGTTGGACACAAGCTCTATTCAGCCGGATAGAATCCTGCTCAT GGACACTTTCTTCCAGATACTCATTTTCCATGGAGAGACCATTGCCCAATGGCG |
| PC014 | SEQ ID NO: 269<br>CGCAGATCAAR<br>CAYATGATGGC | SEQ ID NO: 270<br>CGGATCTCGG<br>GCASMARYTG<br>C | SEQ ID NO: 255<br>CTGATGTTCAAAAACAAATCAAACACATGATGGCTTTCATTGAACAAGAAGCCAATGAGAAAGCA GAAGAAATTGATGCCAAGGCAGAGGAGGAATTCAACATTGAAAAAGGGCGTTTGGTCCAGCAAC AGAGACTCAAGATCATGGAGTACTACGAGAAAAGGAGAAGCAAGTCGAACTTCAAAAGAAAATT CAGTCCTCTAATATGTTGAATCAGGCTCGTTTGAAGGTGCTGAAAGTGAGAGAGGACCATGTCAG AGCAGTCCTGGAGGATGCTCGTAAAAGTCTTGGTGAAGTAACCAAAGACCAAGGAAAATACTCC CAAATTTTGGAGAGCCTAATCCTACAAGGACTGTTCCAGCTGTTCGAAGAAGGAGGTGACGGTCC GCGTGAGACCGCAAGACAGGGACCTGGTCAGGTCCATCCTGCCCAACGTCGCTGCCAAATACA AGGACGCCACCGGCAAAGACATCCTACTCAAGGTGGACGATGAGTCGCACCTGTCTCAGGAGAT CACCGGAGGCGTCGATTTGCTCGCTCAGAAGAACAAGATCAAGATCAGCAACACGATGGAGGCT AGGTTGGATCTGATCGCTCA |
| PC016 | SEQ ID NO: 271<br>GACTGTGTCTG<br>GTGTRAACGG<br>WCC | SEQ ID NO: 272<br>GGAATAGGAT<br>GGGTRATRTC<br>GTCG | SEQ ID NO: 257<br>GGAATAGGATGGGTGATGTCGTCGTTGGGCATAGTCAAGATGGGGATCTGCGTGATGGAGCCG TTGCGGCCCTCCACACGACCGGCGCGCTCGTAAATGGTGGCCAGATCGGTGTACATGTAACCG GGGAAACCCCTACGGCCGGGCACTTCTTCTCGAGCGGCAGACACCTCACGCAACGCCTCCGCG TACGACGACATGTCGGTCAAGATGACCAGCACGTGCTTCTCGCACTGGTAGGCCAAGAATTCGG CGGCCGTCAGAGCCAAACGCGGCGTGATGATGCGCTCGATGGTCGGATCGTTGGCCAAGTTCA AGAACAGACACACGTTCTCCATCGAGCCGTTCTCTTCGAAGTCCTCCTGCTTGAAGAACCTGGCAGTT TCCATGTTGACACCCATAGCAGCAAACACAATAGCAAAGTTGTCTTCATGGTCATCCAGCACAGA CTTGCCAGGTACTTTGACCAAGCCAGCCTGCCTACAAATCTGGGCTGCAATCTCATTGTGGGGC AGCCCAGCGGCGGAGAAGATCGGAATCTTCTGCCCTCTGGCGATAGAGTTCATCACGTCGATGG CCGTGATCCCAGTCTGGATCATTTCCTCGGGATAAATACGCGACCACGGGTTGATCGGCTGTCC TTGGATGTCGAGGTAGTCCTCAGCCAGGATCGGGGGACCCTTTATCAATGGGTTTTCCTGATCCAT TGAAGACACGTCCCAGCATATCTTCTGATACTGGAGTTCTTAGAATATCTCCAGTGAACTCACAC ACCGTGTTCTTAGCATCAATACCTGATGTGCCTTCAAATACCTGAACAACTGCCTTTGATCCACTG ACTTCCAAAACTTGTCCAGATCGTAGAGTTCCATCTGCCAATTTGAGCTGGACAATTTCATTGAAT TTTGGAAACTTGACATCCTCAAGAATGACCAGTGGTCCGTTCACACCAGACACAGTC |
| PC027 | SEQ ID NO: 273<br>GGGCCAAGCA<br>CWSYGAAATRC<br>AG | SEQ ID NO: 274<br>TGTGCCACCC<br>TAGTRCGRTG<br>YTC | SEQ ID NO: 259<br>GGGCCAAGCACAGTGAAATACAGCAAGCTAACTTGAAAGCACTACCAGAAGGAGCTGAAATCAG AGATGGAGAACGTTTGCCAGTCACAGTAAAGGACATGGGAGCATGCGAGATTTACCCACAAACA ATCCAACACAACCCCAATGGGCGGTTTGTAGTGGTTTGTGGTGATGGAGAATACATAATATACAC GGCTATGGCCCTTCGTAACAAAGCATTTGGTAGCGCTCAAGAATTTGTATGGGCACAGGACTCC AGTGAATATGCCATCCGCGAATCCGGATCCACCATTCGAATCTTCAAGAATTTCAAAGAAAAAAA GAATTTCAAGTCCGACTTTGGTGCCGAAGGAATCTATGGTGGTTTTCTCTTGGGTGTGAAATCAG TGTCTGGCTTAGCTTTCTATGACTGGGAAACGCTTGAGTTAGTAAGGCGCATTGAAATACAGCCT AGAGCTATCTACTGGTCAGATAGTGGCAAGTTGGTATGCCTTGCTACCGAAGATAGCTATTTCAT ATTGTCCTATGACTCTGACCAAGTCCAGAAAGCTAGAGATAACAACCAAGTTGCCGAAGATGGAG TGGAGGCTGCCTTTGATGTCCTAGGTGAAATAAATGAATCCGTAAGAACAGGTCTTTGGGTAGGA GACTGCTTCATTTACACAAACGCAGTCAACCGTATCAACTACTTTGTGGGTGGTGAATTGGTAAC TATTGCACATCTGGACGTCCTCTATATGTCCTGGGCTATGTACCTAGAGATGACAGGTTATACT TGGTTGATAAAGAGTTAGGAGTAGTCAGCTATCAATTGCTATTATCTGTACTGAATATCAGACTG CAGTCATGCGACGAGACTTCCCAACGGCTGATCGAGTATTGCCTTCAATTCCAAAAGAACATCGC ACTAGGGTGGCACA |

TABLE 2-EV

| Target ID | Primer Forward 5' → 3' | Primer Reverse 5' → 3' | cDNA Sequence (sense strand) 5' → 3' |
|---|---|---|---|
| EV005 | SEQ ID NO: 523<br>TGCGATGCGG<br>CAARAARAAGG<br>TBTGG | SEQ ID NO: 524<br>TCCTGCTTCTT<br>SGYRGCRATW<br>CGYTC | SEQ ID NO: 513<br>TGCGATGCGGCAAGAAGAAGGTTTGGCTGGATCCTAATGAAATAACTGAAATTGCTAATACA AACTCTAGACAAAACATCCGCAAACTGATTAAAGATGGTGCTTATTATTAAAAAGCCTGTCGCG GTGCATTCTCGTGCACGTGTACGCAAAAATACTGAAGCCCGCAGGAAAGGTCGTCATTGTG GATTTGGTAAAAGGAAAGGAACTGCAAATGCTAGGATGCCCAGAAAGGAATTATGGATTCAA CGTATGAGAGTTCTCAGAAGGTTATTGAAGAAATATAGGGAAGCTAAGAAAATTGATAGGCA TTTATACCATGCTTTATATATGAAAGCTAAGGGAAATGTATTCAAGAATAAGAGAGTAATGAT GGACTATATCCATAAAAAGAAGGCGGAGAAAGCACGTACAAAGATGCTCAATGATCAAGCT GATGCAAGGAGGCTGAAAGTCAAAGAGGCACGTAAGCGACGTGAAGAGCGTATCGCTACG AAGAAGCAGGA |
| EV009 | SEQ ID NO: 525<br>GGGCCGTGGT<br>CAGAAYATYWA<br>YAAC | SEQ ID NO: 526<br>GCAGCCCACG<br>CYYTGCACTC | SEQ ID NO: 515<br>CCAACTCTCGATCCAAGCATTCCAAAATACAGGACTGAAGAATCTATAATAGGAACAAACCC AGGAATGGGTTTTAGGCCAATGCCCGACAACAACGAAGAAAGTACCCTGATTTGGTTACAG GGTTCTAATAAAACAACTACGAAAAATGGAAAATGATTCTCCTCTCATATTTAGACAAGTAT TACACTCCCGGAAAAATGAAAAAGGGAAATATTTCCAGTAAAAGCGCTGTTCATACGGAGAAAA ATTGATTAGGGGACAAGTATGTGATGTAGATGTGAGGAAATGGGAGCCGTGCACCCCGGAA AATCATTTTGATTACCTCAGAAATGCGCCTTGTATATTTCTGAAGCTGAACAGGATATATGGA TGGGAACCGGAGTACTACAACGATCCAAATGATCTTCCAGATGATATGCCGCAGCAGTTGA AGGACCATATACGTTATAATATCACCAATCCAGTGGAGAGAAATACCGTCTGGGTAACATGC |

TABLE 2-EV-continued

| Target ID | Primer Forward 5' → 3' | Primer Reverse 5' → 3' | cDNA Sequence (sense strand) 5' → 3' |
|---|---|---|---|
| | | | GCAGGTGAAAATCCGGCAGACGTGGAGTACTTGGGCCCTGTGAAGTATTACCCATCTTTCC AGGGATTCCCCGGTTACTATTTTCCATATTTGAATTCTGAAGGGTACCTAAGTCCATTATTGG CGGTACAATTCAAGAGACCGGTGTCTGGTATTGTTATAAATATCGAGTGCAAAGCGTGGGCT GC |
| EV010 | SEQ ID NO: 527 CGGCTGACGT GGAAYGTKTGG CC | SEQ ID NO: 528 CGGCGTATTCT CCRAAYTTCTG GC | SEQ ID NO: 517 CTGGCGGCCACATGGTCATGGGTGATTCATTTAACTCTTCACTTTTCAAACAAACATTTCAAC GAGTATTTTCGAAAGATTCCAATGGAGACTTGAAGATGTCCTTCAACGCCATATTAGAAGTG AAGTGTTCTAGAGAACTTAAAGTACAAGGAGGTATAGGTCCTTGTGTCTCTAAATGTCAA AAATCCTCTTGTTTCTGATTTAGAAATAGGCATGGGTAACACAGTTCAGTGGAAACTGTGTA GCTTAAGTCCAAGCACTACGGTTGCCTTATTTTTCGAAGTTGTTAATCAGCATGCAGCACCC ATTCCTCAAGGGGGACGTGGATGCATTCAGTTTATTACTCAATATCAGCATTCAAGTGGTCA GAAAAAAATAAGGGTAACTACAATAGCAAGAAATTGGGCGGATGCCACTGCAAATATTCACC ATATTAGCGCTGGCTTTGACGAACAAACTGCGGCTGTTTTAATGGCGGAGGATCGCTGTATAT AGAGCAGAAACTGATGAGAGTTCAGATGTTCTCAGATGGGTTGACAGAATGTTGATACGATT GTGTCAGAAATTTGGAGAATATAACAAAGATGACACCAACAGCTTCAGGCTCAGTGAAAACT TCAGCTTATATCCACAGTTTATGTATCATCTACGTCGTTCCCAATTTCTACAAGTGTTCAATAA TTCACCAGATGAAACTTCATTCTATAGGCACATGTTGATGAGGGAAGATCGCAATCAG |
| EV015 | SEQ ID NO: 529 CGCTGTCGCAR GCRAARATGG | SEQ ID NO: 530 CGATCAAAGC GWCCRAAVCG ACG | SEQ ID NO: 519 CGCCATCCGTCGCTGTTCAAGGCGATCGGCGTTAAGCCTCCAAGGGGTATTCTCCTTTACG GGCCTCCCGGCACGGGGAAAACGCTGATCGCCAGGGCCGTTGCCAACGAAACTGGTGCGT TCTTCTTCCTCATCAATGGGCCCGAGATTATGAGCAAGCTGGCCGGAGAATCCGAGAGCAA TCTTAGAAAGGCTTTTGAAGAGGCTGATAAAAACTCTCCTGCAATCATCTTTATCGACGAATT AGACGCAATCGCTCCCAAGCGCGAGAAGACTCATGGTGAGGTAGAGAGACGCATCGTCTC CCAACTGTTGACTTTGATGGACGGCATGAAGAAAAGTTCCCATGTGATCGTGATGGCGGCC ACGAACAGGCCCAATTCCATCGACCCTGCACTCAGACGTTTCGGCCGATTCGACAGAGAGA TCGACATCGGTATCCCCGACGCTACTGGAAGATTAGAAGTACTCAGAATACACACCAAAAAC ATGAAATTGGCTGACGATGTAGATTTGGAACAGATTGCCGCAGAGACTCACGGTCATGTAG GTGCTGACTTGGCTTCTTTGTGCTCAGAGGCTGCCTTGCAACAAATTAGAGAAAAAATGGAC CTCATCGACTTAGATGATGAGCAGATCGATGCCGAAGTCCTAAATTCTCTGGCAGTTACCAT GGAGAACTTCCGTTACGCCATGTCTAAGAGCAGTCCGAGCGCTTTGCGCGAAACCGTCGT |
| EV016 | SEQ ID NO: 531 GTTCACCGGC GAYATYCTGCG | SEQ ID NO: 532 CGGCATAGTC AGAATSGGRAT CTG | SEQ ID NO: 521 GACTGTGTCTGGTGTGAACGGACCGTTGGTGATCCTTGATAGTGTTAAGTTTCCAAAATTTA ACGAAATTGTACAGCTCAAGTTATCAGATGGAACAGTTAGGTCTGGACAAGTTTTGGAAGTC AGTGGACAGAAGGCGGTTGTCCAAGTTTTTGAAGGCACCTCCGGAATTGATGCTAAAAACA CTTTATGTGAATTTACAGGAGATATCTTAAGAACTCCAGTGTCTGAAGATATGTTGGGTCGT GTGTTTAATGGATCTGGAAAGCCTATCGATAAAGGGCCGCCAATCTTAGCTGAAGATTTTCT TGACATTCAAGGTCAACCTATAAATCCTTGGTCTCGTATCTATCCAGAGAAATGATCCAGA CTGGTATTTCTGCGATTGATGTGATGAATTCCATTGCCAGAGGACAAAAGATTCCAATTTTCT CTGCAGCTGGTTTACCCCACAATGAAATCGCTGCTCAAATCTGTAGACAAGCTGGTCTTGTC AAAATCCCAGGGAAATCTGTCTTAGATGATCATGAAGACAACTTTGCTATCGTTTTCGCCGC TATGGGTGTCAATATGGAAACAGCCAGATTCTTCAAGCAAGATTTTGAAGAGAATGGCTCTA TGGAAAATGTGTGCCTATTTTTGAACTTGGCCAATGATCCTACCATTGAAAGAATTATAACAC CCCGTTTGACTTTAACAGCGGCTGAATTTATGGCATATCAATGTGAGAAGCATGTTTAGTC ATATTGACTGACATGTCATCTTATGCTGAGGCTTTGCGTGAGGTATCTGCTGCT |

TABLE 2-AG

| Target ID | Primer Forward 5' → 3' | Primer Reverse 5' → 3' | cDNA Sequence (sense strand) 5' → 3' |
|---|---|---|---|
| AG001 | SEQ ID NO: 611 CATTTGAAGCG TTTWRMYGCYC C | SEQ ID NO: 612 CGCTTGTCCC GCTCCTCNGC RAT | SEQ ID NO: 601 CATTTGAAGCGTTTTGCTGCCCCCAAAGCATGGATGTTGGACAAATTGGGGGGTGTGTTCGCCC CCAGGCCCTCCACCGGGCCACACAAGCTCAGGGAGTCCCTTCCATTAGTGATTTTCTTGCGTAA CAGGTTGAAGTACGCCCTGACAAACTCTAACTATCCTGCTGGATTCATGGATGTGATCACCATTGA AAAAACTGGTGAATTCTTCCGTTTGATCTATGATGTTAAGGGAAGATTCACTATTCACAGGATCAC TGCTGAAGAAGCAAATACAAATTGTGCAAAGTCCGCAAGGTGCAAACCGGACCAAAAGGTATTC CATTCTTGGTCACCCACGATGGTAGGACCATTAGGTACCCTGACCCAATGATCAAGGTAAACGAC ACCATCCAACTGGAAATCGCCACCTCAAAGATCCTGGACTTTATCAAATTCGAATCCGGCAACTT GTGCATGATCACCGGAGGCAGGAATTTGGGTAGAGTGGGAACGGTAGTGAACAGGGAAAGGCA TCCGGGATCATTCGATATTGTCCACATTAGGGACGCTAATGATCACGTGTTCGCCACTAGATTAA ACAACGTATTCGTCATCGGTAAAGGAAGCAAAGCTTTCGTGTCTCTGCCAAGGGGCAAGGGAGT GAAACTGTCCATCGCTG |
| AG005 | SEQ ID NO: 613 GGTCTGGTTGG ATCCHAATGAA ATCAAYGA | SEQ ID NO: 614 TCCTGCTTCTT SGYRGCRATW CGYTC | SEQ ID NO: 603 GGTCTGGTTGGATCCAAATGAAATCAATGAGATTGCCAACACCAACTCGAGGCAAAACATCCGTA AATTGATCAAGGATGGTTTGATCATTAAGAAACCGGTGGCAGTGCACTCTAGGGCTCGTGTCCGT AAAAACACAGAAGCTCGCAGGAAGGGAAGGCACTGCGGTTTCGGTAAGAGGAAAGGTACAGCG AACGCTCGTATGCCTCAAAAGGAACTATGGATCCAAAGGATGCGTGTCTTGAGGCGTCTCCTGA AAAAATACAGGGAAGCCAAAAAGATCGACAGGCATCTGTACCACGCCCTGTACATGAAGGCCAA GGGTAACGTGTTCAAGAACAAGAGAGTGTTGATGGAATACATCCACAAGAAGAAGGCTGAGAAG |

TABLE 2-AG-continued

| Target ID | Primer Forward 5' → 3' | Primer Reverse 5' → 3' | cDNA Sequence (sense strand) 5' → 3' |
|---|---|---|---|
| | | | GCCCGTGCCAAGATGTTGGCCGACCAAGCTAACGCCAGAAGGCAAAAGGTGAAACAAGTCCCGTGAGAGGAGGGAAGAGCGTATCGCCGCGAAGAAGCAGGA |
| AG010 | SEQ ID NO: 615 CTGGCGGCCACATGSTBATGG | SEQ ID NO: 616 CGCCATTGGGCRATGGTYTCKCC | SEQ ID NO: 605 CTGGCGGCCACATGCTTATGGGAGACTCTTTCAATTCGTCGTTGTTCAAACAAACTTTCCAAAGGGTGTTCGCGAAGGACCAGAATGGACATTTGAAGATGGCTTTCAACGGTACTTTGGAGGTGAAGTGCTCTAGGGAATTAAAAGTTCAAGGCGGTATTGGCTCATGCGTGTCGCTAAATGTAAAAGTCCTTTGGTAGCGGACACGGAAATAGGCATGGGAAACACCGTGCAATGGAAGATGTGCACCTTCAACCCTAGCACGACGATGGCGCTGTTTTTCGAGGTGGTCAATCAGCATTCGGCCCCCATTCCTCAAGGTGGTAGAGGATGGTATACAGTTTATTACACAATATCAGCACTCGAGTGGCCAAAGGAGGATAAGGGTGACGACGATAGCGAGAAATTGGGCGGACGCATCGGCGAATATTCACCACATCAGCGCGGGTTTCGATCAGGAACGTGCCGCGGTGATTATGGCCCGGATGGCTGTTTATAGAGCGGAGACCGATGAGAGTCCCGATGTTTTAAGATGGGTCGATCGGATGCTGATTCGTTGTGTCAAAAGTTTGGAGAATATAACAAAGATGACCAGGCATCCTTCAGATTAGGAGAAATTTTAGCTTATACCCGCAATTCATGTACCACTTAAGGCGATCCCAGTTTTTGCAAGTGTTCAACAATTCACCTGACGAAACGTCGTTTTACAGGCATATGCTTATGAGGGAAGATTTGACACAGTCCCTGATAATGATTCAGCCGATCTTGTACAGTTACAGTTTTAATGGTCCTCCGGAGCCCGTTTTGTTGGACACCAGCTCAATACAACCGGACAGAATTCTGCTTATGGACACGTTTTTCCAGATATTGATTTTCCATGGAGAAACCATTGCCCAATGGCG |
| AG014 | SEQ ID NO: 617 CGCAGATCAARCAYATGATGGC | SEQ ID NO: 618 GAACTTGCGGTTGABGTTSCGDCC | SEQ ID NO: 607 CGCAGATCAAGCATATGATGGCCTTCATTGAGCAAGAGGCTAATGAAAAGGCCGAGGAAATTGATGCCAAGGCGGAAGAAGAATTTAACATTGAAAAGGGCCGCCTTGTGCAACAACAAGATTGAAGATCATGGAATACTATGAGAAGAAGGAGAAGCAAGTCGAACTACAAAAGAAAATTCAATCCTCCAACATGCTGAACCAAGCCCGTCTTAAGGTTCTGAAAGTCCGCGAAGATCATGTTAGAGCTGTATTGGATGAGGCTCGCAAGAAGCTTGGTGAAGTCACCAGGGATCAAGGCAAATATGCCCAGATTCTGGAATCTTTGATCCTTCAGGGACTCTACCAGCTTTTCGAGGCAAACGTGACCGTACGCGTCGCCCAAGAACAGAACCTTAGTCCAATCAGTGCTGCCAACCATCGCAACCAAATACCGTGACGTCACCGGCCGAGATGTACACCTGTCCATCGATGACGAAACTCAACTGTCCGAATCGTAACCGGCGGAATCGAACTTTTGTGCAAACAAACAAAATTAAGGTCTGCAACACCCTGGAGGCACGTTTGGACCTGATTTCGCAACAGTTGGTTCCGCAAATCCGTAACGCCTTGTTCGGACGCAACATCAACCGCAAGTTC |
| AG016 | SEQ ID NO: 619 GTGTCGGAGGATATGYTGGGYCG | SEQ ID NO: 620 GGAATAGGATGGGTRATRTCGTCG | SEQ ID NO: 609 GTGTCGGAGGATATGTTGGGCCGAGTGTTCAACGGATCAGGAAAACCCATTGACAAAGGTCCTCCAATCTTAGCCGAAGATTTCTTGGACATCCAAGGTCAACCCATCAACCCATGGTCGCGTATCTACCCGGAAGAAATGATCCAGACCGGTATCTCCGCCATCGACGTGATGAACTCCATCGCGCGTGGGCAAAAATCCCCATTTTCTCCGCGGCCGGTTTACCGCACAACGAAATCGCCGCCCAAATCTGTAGACAGGCCGGTTTAGTCAAACTGCCGGGCAAATCGGTAATCGACGATCACGAGGACAATTTCGCCATCGTGTTCGCCGCCATGGGTGTCAACATGGAAACCGCCCGTTTCTTCAAGCAGGACTTCGAAGAAAACGGTTCCATGGAGAACGTGTGTCTCTTCTTGAATTTGGCCAACGATCCCACCATCGAGAGAATCATCACGCCCCGTTTGGCTCTGACCGCCGCCGAATTTTTGGCTTATCAATGCGAGAAACACGTGCTGGTTATCTTAACTGATATGTCTTCTTACGCCGAGGCTTTCGTGAAGTATCCGCCGCCAGAGAAGAAGTACCCGGACGTCGTGGGTTCCCCGGTTACATGTACACCGATTTGGCCACCATTTACGAAAGAGCCGGTCGCGTTGAGGGTAGAAACGGTTCCATCACCCAGATTCCCATCTTGACTATGCCGAACGACGACATCACCCATCCTATTCC |

TABLE 2-TC

| Target ID | Primer Forward 5' → 3' | Primer Reverse 5' → 3' | cDNA Sequence (sense strand) 5' → 3' |
|---|---|---|---|
| TC001 | SEQ ID NO: 803 GGCCCCAAGAAGCATTTGAAGCG | SEQ ID NO: 804 CGCTTGTCCCGCTCCTCNGCRAT | SEQ ID NO: 793 GGCCCCAAGAAGCATTTGAAGCGTCTCAATGCGCCCAAAGCATGGATGTTGGATAAACTGGGGGGTGTGTTTGCCCGTCGGCCTTCCACCGGCCCCACAAGCTACGGGAGTCGCTACCTTTGGTTATCTTCCTGCGAAACAGGCTGAAGTATGCCTTGACCAACTCAGAAGTGACGAAGATTGTTATGCAAAGATTGATTAAAGTTGACGGAAAAGTTAGGACAGACCCCAACTACCCCGCGGGTTTCATGGATGTTGTGACTATTGAGAAAACTGGGGAATTCTTCCGCTTGATTTATGATGTTAAGGGAAGGTTCACAATCCATCGCATTACTGGAGAAGAGGCCAATATAAATTGTGCAAAGTGAAGAAAGTACAGACAGGCCCCAAGGGCATTCCCTTCTTGGTGACCCGCGACGGACGCACTATCAGATACCCAGACCCCATGATCAAAGTGAATGACACCATTCAATTGGAGATTGCCACTTCGAAAATTCTTGATTTTATCAAATTTGAGTCCGGTAATTTGTGTATGATTACTGGAGGTCGTAACTTGGGCGTGTCGGTACAGTGGTGAGCCGAGAACGTCACCCAGGTTCCTTCGACATCGTTCATATTAAGGATGCAAATGGGCACACC |
| TC002 | SEQ ID NO: 805 CAGGAGTTCCTGGARRMBAARATMGA | SEQ ID NO: 806 GCAATGTCATCCATCAKRTCRTGTAC | SEQ ID NO: 795 CAGGAGTTCCTGGAGGCTAAAATCGACCAAGAGATCCTCACAGCGAAGAAAACGCGTCGAAAAACAAACGAGCGGCCATCCAGGCCATCAAGAGGAAGAAACGCTACGAAAAGCAGCTCCAGCAGATCGATGGCACCCTCAGCACCATCGAGATGCAGCGGGAGGCCCTCGAGGGGGCCAACACCAACACAGCCGTACTCAAAACGATGAAAAACGCAGCGGACGCCCTCAAAAATGCCCACCTCAACATGGATGTTGATGAGGTACATGACATGATGGATGACATTGC |
| TC010 | SEQ ID NO: 807 GCATTCTGCGCTGGGTCGATCG | SEQ ID NO: 808 TGCCGGAAGTTCTCRTAYTCKGGC | SEQ ID NO: 797 AAAATTCGGCGAATACAACAAAGACGACCCTAACAGTTTCCGTTTGAGTGAAAACTTCAGTCTCTATCCCCAATTCATGTACCATTTGCGCCGCTCCCAATTCCTCCAAGTTTTCAACAACTCCCCAGACGAGACCTCGTTCTACCGCCACATGCTGATGCGGGAGGACCTCACCCAAAGT |

TABLE 2-TC-continued

| Target ID | Primer Forward 5' → 3' | Primer Reverse 5' → 3' | cDNA Sequence (sense strand) 5' → 3' |
|---|---|---|---|
| | | | CTCATTATGATCCAGCCGATTTTGTACAGTTATAGTTTCAACGGCCCCCCTGAACCCGTCC TCCTCGACACTAGTTCCATTCAACCCGATCGGATCCTTCTCATGGACACATTTTTCCAAATT TTGATTTTCCACGGTGAGACAATCGCCCAATGGAGGAACCTCAAGTACCAGGACATGCCC GAATACGAGAACTTCCGGCA |
| TC014 | SEQ ID NO: 809 GAGAAAGCCG ARGARATYGAT GC | SEQ ID NO: 810 GAACTTGCGG TTGABGTTSCG DCC | SEQ ID NO: 799 GAGAAAGCCGAAGAAATCGATGCGAAAGCTGAGGAGGAGTTTAACATTGAAAAAGGGCG CCTGGTCCAACAACAGCGCTTGAAGATCATGGAATATTACGAGAAGAAGGAGAAACCGGT GGAATTGCAGAAGAAAATTCAGTCGTCAAACATGCTGAACCAAGCCCGTTTGAAAGTATTA AAAGTGCGTGAAGACCACGTCCACAATGTGCTGGATGACGCCCGCAAACGTCTGGGCGA AATCACCAATGACCAGGCGAGATATTCACAACTTTTGGAGTCTCTTATCCTCCAGAGTCTC TACCAGTACTTGGGAATCAGTGATGAGTTGTTTGAGAACAATATAGTGGTGAGAGTCAGG CAACAGGACAGGAGTATAATCCAGGGCATTCTCCCAGTTGTTGCGACGAAATACAGGGAC GCCACTGGTAAAGACGTTCATCTTAAAATCGACGATGAGAGCCACTTGCCATCCGAAACC ACCGGAGGAGTGGTTTTGTATGCGCAAAAGGGTAAAATCAAGATTGACAACACCTTGGAG GCTCGTTTGGATTTAATTGCACAGCAACTTGTGCCAGAAATTCGTACGGCCTTGTTTGGAC GCAACATCAACCGCAAGTTC |
| TC015 | SEQ ID NO: 811 GGATGAACTAC AGCTBTTCCGH GG | SEQ ID NO: 812 CGATCAAAGC GWCCRAAVCG ACG | SEQ ID NO: 801 GGATGAACTACAGCTGTTCCGTGGCGATACAGTGTTGCTGAAAGGGAAGCGGCGGAAAG AGACCGTCTGCATTGTGCTGGCCGACGAAAACTGCCCCGATGAGAAGATCCGGATGAAC AGGATCGTCAGGAATAATCTACGGGTTAGGCTCTCTGACGTCGTCTGGATCCAGCCCTGT CCCGACGTCAAATACGGGAAGAGGATCCACGTTTTGCCCATCGATGACACGGTCGAAGG GCTCGTCGGAAATCTCTTCGAGGTGTACTTAAAAACCATACTTCCTCGAAGCTTATCGACCA ATCCACAAAGGCGACGTTTTCATCGTCCGTGGTGGCATGCGAGCCGTTGAATTCAAAGTG GTGGAAACGGAACCGTCACCATATTGTATCGTCGCCCCGATACCGTCATCCATTGTGAC GGCGATCCGATCAAACGAGAAGAAGAGGAGGAAGCCTTGAACGCCGTCGGCTACGACGA TATCGGCGGTTGTCGCAAACAACTCGCACAAATCAAAGAAATGGTCGAATTACCTCTACG CCACCCGTCGCTCTTCAAGGCCATTGGCGTGAAACCACCACGTGGTATCCTCTTGTACGG ACCTCCAGGTACCGGTAAAACTTTAATCGCACGTGCAGTGGCCAACGAAACCGGTGCTTT CTTCTTCTTAATCAACGGTCCCGAAATTATGAGTAAATTAGCCGGCGAATCCGAAAGTAAT CTAAGGAAAGCGTTCGAAGAAGCCGATAAAAACTCACCGGCTATTATTTTCATCGATGAAT TGGACGCGATTGCACCGAAACGTGAAAAAACCCACGGCGAAGTCGAACGCCGAATTGTC TCGCAATTGTTAACACTGATGGACGGCATGAAGAAAAGCTCGCATGTTATCGTGATGGCG GCCACAAATCGCCCGAACTCAATCGATCCGGCTTTGCGTCGGTTCGGTCGCTTTGATCG |

TABLE 2-MP

| Target ID | Primer Forward 5' → 3' | Primer Reverse 5' → 3' | cDNA Sequence (sense strand) 5' → 3' |
|---|---|---|---|
| MP001 | SEQ ID NO: 898 GGCCCCAAGAA GCATTTGAAGC G | SEQ ID NO: 899 CGCTTGTCCC GCTCCTCNGC RAT | SEQ ID NO: 888 GGCCCCAAGAAGCATTTGAAGCGTTTAAACGCACCCAAAGCATGGATGTTGGACAAATCGGG GGGTGTCTTCGCTCCACGTCCAAGCACCGGTCCACACAAACTTCGTGAATCACTACCGTTATT GATCTTCTTGCTGTAATCGTTTGAAGTATGCACTTACTGGTGCCGAAGTCACCAAGATTGTCAT GCAAAGATTAATCAAGGTTGATGGCAAAGTCCGTACCGACCCTAATTATCCAGCCGGTTTTAT GGATGTTATATCTATCCAAAAGACCAGTGAGCACTTTAGATTGATCTATGATGTGAAAGGTCG TTTCACCATCCACAGAATTACTCCTGAAGAAGCAAAATACAAGTTGTGTAAAGTAAAGAGGGT ACAAACTGGACCCAAAGGTGTGCCATTTTTAACTACTCATGATGGCCATACTATTCGCTACCC TGACCCTAACATCAAGGTTAATGACACTATTAGATACGATATTGCATCATCTAAATTTTGGAT CATATCCGTTTTGAAACTGAAACTTGTGCATGATAACTGGAGGTCGCAATTTAGGGCGTGTT GGTATTGTTACCAACAGGGAAAGACATCCAGGATCTTTTGATATTGTTCACATTAAGGATGCA AATGAACATATTTTTGCTACCCGGATGAACAATGTTTTTATTATTGGAAAAGGTCAAAAGAACT ACATTTCTCTACCAAGGAGTAAGGGAGTTAAATTGACTAT |
| MP002 | SEQ ID NO: 900 GAGTTTCTTTA GTAAAGTATTC GGTGG | SEQ ID NO: 901 GCAATGTCATC CATCAKRTCRT GTAC | SEQ ID NO: 890 GAGTTTCTTTAGTAAAGTATTCGGTGGCAAAAAGGAAGAGAAGGGACCATCAACCGAAGATG CGATACAAAAGCTTCGATCCACTGAAGAGATGCTGATAAAGAAACAAGAATTTTTAGAAAAAA AAATTGAACAAGAAGTAGCGATAGCCAAAAAAAATGGTACAACTAATAAACGAGCTGCATTGC AAGCATTGAAGCGTAAGAAACGGTACGAACAACAATTAGCCCAAATTGATGGTACCATGTTAA CTATTGAACAACAGCGGGAGGCATTAGAAGGTGCCAACACAAATACAGCAGTATTGACTACC ATGAAAACTGCAGCAGATGCACTTAAATCAGCTCATCAAAACATGAATGTAGATGATGTACAT GATCTGATGGATGACATTG |
| MP010 | SEQ ID NO: 902 GTGGCTGCATA CAGTTCATTAC GCAG | SEQ ID NO: 903 CGCGGCTGCT CCATGAAYASY TG | SEQ ID NO: 892 GTGGCTGCATACAGTTCATTACGCAGTATCAACATTCCAGTGGCTATAAACGAATTAGAGTCA CCACATTAGCTAGGAATTGGGCAGACCCTGTTCAGAATATGATGCATGTTAGTGCTGCATTTG ATCAAGAAGCATCTGCCGTTTTAATGGCTCGTATGGTAGTGAACCGTGCTGAAACTGAGGATA GTCCAGATGTGATGCGTTGATCGTACGCTTATACGCTTGTGTCAAAATTTGGTGATT ATCAAAAGATGATCCAAATAGTTTCCGATTGCCAGAAAACTTCAGTTTATATCCACAGTTCAT GTATCATTTAAGAAGGTCTCAATTTCTACAAGTTTTTAATAATAGTCCTGATGAAACATCATATT ATAGGCACATGTTGATGCGTGAAGATGTTACCCAAAGTTTAATCATGATACAGCCAATTCTGT ATAGCTATAGTTTTAATGGTAGGCCAGAACCTGTACTTTTGGATACCAGTAGTATTCAACCTGA TAAAATATTATTGATGGACACATTTTTCCATATTTTGATATTCCATGGAGAGACTATTGCTCAAT |

TABLE 2-MP-continued

| Target ID | Primer Forward 5' → 3' | Primer Reverse 5' → 3' | cDNA Sequence (sense strand) 5' → 3' |
|---|---|---|---|
| | | | GGAGAGCAATGGATTATCAAAATAGACCAGAGTATAGTAACCTCAAGCAGTTGCTTCAAGCCC CCGTTGATGATGCTCAGGAAATTCTCAAAACTCGATTCCCAATGCCTCGGTATATTGACACAG AACAAGGTGGTAGTCAGGCAAGATTTTTACTATGCAAAGTAAACCCATCTCAAACACATAATAA TATGTATGCTTATGGAGGGTGATGGTGGAGCACCAGTTTTGACAGATGATGTAAGCTTGCAG CTGTTCATGGAGCAGCCGCG |
| MP016 | SEQ ID NO: 904 GTGTCGGAGG ATATGYTGGGY CG | SEQ ID NO: 905 GGAATAGGAT GGGTRATRTC GTCG | SEQ ID NO: 894 GTGTCGGAGGATATGTTGGGCCGCGTTTTCAATGGCAGTGGAAAGCCGATAGATAAAGGACC TCCTATTTTGGCTGAAGATTATTTGGATATTGAAGGCCAACCTATTAATCCATACTCCAGAACA TATCCTCAAGAAATGATTCAAACTGGTATTTCAGCTATTGATATCATGAACTCTATTGCTCGTG GACAAAAAATTCCAATATTTTCAGCTGCAGGTTTACCACATAATGAGATTGCTGCTCAAATTTG TAGACAAGCTGGTCTCGTTAAAAAACCTGGTAAATCAGTTCTTGACGATCATGAAGACAATTTT GCTATAGTATTTGCTGCTATGGGTGTTAATATGGAAACAGCCAGATTCTTTAAACAAGATTTTG AGGAAAATGGTTCAATGGAGAATGTTTGTTTGTTCTTGAATTTAGCTAATGATCCTACTATTGA GCGTATCATTACACCACGTCTTGCTTTAACTGCTGCTGAATTTTTAGCTTACCAATGTGAAAAG CATGTCTTAGTTATTTTAACTGACATGAGTTCATATGCTGAAGCTTTAAGAGAAGTTTCTGCTG CTCGTGAAGAAGTACCTGGGCGTCGTGGTTTCCCTGGTTACATGTACACCGATTTAGCTACAA TTTATGAACGTGCTGGGCGTGTAGAAGGAAGAAATGGTTCTATCACACAAATACCTATTTTAA CTATGCCTAACGACGACATCACCCATCCTATTCC |
| MP027 | SEQ ID NO: 906 CGCCGATTACC AAAACAARACB TG | SEQ ID NO: 907 GGGATACTGT CACAAYYTCDC CRCC | SEQ ID NO: 896 CGCCGATTACCAAAACAAGACGTGTGTTCAGACATTAGAAGGCCATGCTCAAAATATTTCTGC TCGTTTGTTTCCATCCAGAACTTCCCATCGTGTTAACTGGCTCAGAAGATGGTACCGTCAGAA TTTGGCATTCTGGTACTTATCGATTAGAATCATCATTAAACTATGGGTTAGAACGTATGGAC AATCTGTTGCTTACGGGGATCTAATAATGTAGCTCTAGGTTATGATGAAGGAAGTATAATGGT TAAAGTTGGTCGTGAAGAGCCAGCAATGTCAATGGATGTTCATGGGGGTAAAATTGTTTGGG CACGTCATAGTGAAATTCAACAAGCTAACCTTAAAGCGATGCTTCAAGCAGAAGGAGCCGAAA TCAAAGATGGTGAACGTTTACCAATACAAGTTAAAGACATGGGTAGCTGTGAAATTTATCCAC AGTCAATATCTCATAATCCGAATGGTAGATTTTTAGTAGTATGTGGTGATGGAGAGTATATTAT ATATACATCAATGGCTTTGCGTAATAAAGCATTTGGCTCCGCTCAGGATTTTGTATGGTCTTCT GATTCTGAGTATGCCATTAGAGAAAATTCTTCTACAATCAAAGTTTTTAAAAATTTTAAAGAAAA AAGTCTTTTAAACCAGAAGGTGGAGCAGATGGTATTTTTGGAGGTTATTGTTAGGTGTGAA ATCTGTTACTGGGTTGGCTTTATATGATTGGGAAAATGGTAACTTAGTTCGAAGAATTGAGAC ACAACCTAAACATGTATTTTGGTCAGAGTCTGGAGAATTAGTATGTCTTGCCACAGATGAAGC ATACTTTATTTTACGTTTTGACGTCAATGTACTTAGTGCTGCAAGAGCATCCAATTATGAAGCT GCTAGTCCTGATGGTCTTGAAGATGCCTTTGAGATTTTAGGAGAAGTTCAAGAAGTTGTAAAA ACTGGTCTATGGGTTGGTGATTGCTTTATTTACACCAATGGAGTAAATCGTATCAACTATATG TTGGTGGTGAAGTTGTGACAGTATCCC |

TABLE 2-NL

| Target ID | Primer Forward 5' → 3' | Primer Reverse 5' → 3' | cDNA Sequence (sense strand) 5' → 3' |
|---|---|---|---|
| NL001 | SEQ ID NO: 1117 GAAATCATGGAT GTTGGACAAATT GG | SEQ ID NO: 1118 ACTGAGCTTCACAC CCTTGCCC | SEQ ID NO: 1071 GAAATCATGGATGTTGGACAAATTGGGTGGTGTGTATGCACCCCGACCCAGCACAGG TCCACACAAGCTGCGAGAATCTCTCCCACTTGTCATATTTTTGCGTAATCGGCTCAAG TACGCTTTAACTAACTGTGAAGTGAAGAAAATTGTGATGCAGCGTCTCATCAAGGTTG ACGGCAAAGTGAGGACTGACCCCAACTATCCTGCAGGTTTTTATGGACGTTGTTCAAAT CGAAAAGACAAACGAGTTCTTCCGTTTGATCTATGATGTTAAGGGACGTTTCACCATC CACAGGATCACAGCTGAAGAAGCTAAGTACAAGCTGTCAAAGTGAAGAGGGTTCAG ACAGGACCCAAGGGCATTCCATTTTTGACCACTCACGATGGACGCACCATCAGGTAT CCAGACCCCCTTGGTAAAAGTCAATGACACCATCCAATTGGACATTGCCACATCCAAAA TCATGGACTTCATCAGATTCGACTCTGGTAACCTGTGTATGATCACTGGAGGTCGTAA CTTGGGTCGTGTGGGCACTGTCGTGAACAGGGAGCGACACCCGGGTCTTTCGACA TCGTGCACATCAAGGACGTGTTGGGACACACTTTTGCCACTAGGTTGAACAACGTTTT CATCATCGGCAAGGGTAGTAAAGCATACGTGTCTCTGCCCAAGGGCAAGGGTGTGAA GCTCAGT |
| NL002 | SEQ ID NO: 1119 GATGAAAAGGG CCCTACAACTG GC | SEQ ID NO: 1120 CTGATCCACATCCA TGTGTTGATGAG | SEQ ID NO: 1073 GATGAAAAGGGCCCTACAACTGGCGAAGCCATTCAGAAACTACGCGAAACAGAGGAA ATGCTGATAAAGAAACAAGACTTTTTAGAAAAGAAATTGAAGTTGAAATTGGAGTTGC CAGGAAGAATGGAACAAAAAACAAAAGAGCCGCGATCCAGGCACTCAAAAGGAAGA GAGGTATGAAAAGCAATTGCAGCAGATCGATGGAACGTTATCAACAATTGAGATGCA GAGAGAGGCCCTCGAAGGAGCCAACACGAATACGGCCGTACTGCAAACTATGAAGA ACGCAGCAGATGCTCTCAAAGCGGCTCATCAACACATGGATGTGGATCAG |
| NL003 | SEQ ID NO: 1121 TCCGCGTCGTC CTTACGAGAAG GC | SEQ ID NO: 1122 TTGACGCGACCAG GTCGGCCAC | SEQ ID NO: 1075 TCCGCGTCGTCCTTACGAGAAGGCACGTCTCGAACAGGAGTTGAAGATCATCGGAGA GTATGCATCCGTAACAAGCGTGAGGTGTGGAGAGTCAAATACGCCCTGGCCAAGAT TCGTAAGGCCGTCGTGAGCTGTTGACTCTGGAAGAGAAGGACCAGAAACGTTTGTT TGAAGGTAACGCCCTGCTGCGTCGCCTGGTGCGTATTGGAGTGTTGGACGAAGGAA GAATGAAGCTCGATTACGTCTTGGGTTTAAAAATTGAAGATTTCCTTGAACGTCGTCT ACAGACTCAGGTGTACAAACTCGGTTTGGCCAAGTCCATCCATCACGCCCGTGTACT |

TABLE 2-NL-continued

| Target ID | Primer Forward 5' → 3' | Primer Reverse 5' → 3' | cDNA Sequence (sense strand) 5' → 3' |
|---|---|---|---|
| | | | CATCAGACAAAGACATATCAGAGTGCGCAAACAAGTAGTGAACATTCCGAGCTTTGTG<br>GTGCGCCTGGACTCGCAGAAGCACATTGACTTCTCGCTGAAGTCGCCGTTCGGCGG<br>TGGCCGACCTGGTCGCGTCAA |
| NL004 | SEQ ID NO: 1123<br>TGAAGGTGGAG<br>AARGGTTYGGM<br>WCMAAG | SEQ ID NO: 1124<br>GTCGTCTTCTCDGA<br>HACRTAVAGACC | SEQ ID NO: 1077<br>AAGGAGTTGGCTGCTGTAAGAACTGTCTGCTCTCACATCGAAAACATGCTGAAGGGA<br>GTCACAAAGGGATTCCTGTACAAGATGCGTGCCGTGTACGCCCATTTCCCCATCAAC<br>TGTGTGACGACCGAGAACAACTCTGTGATCGAGGTGCGTAACTTCCTGGGCGAGAAG<br>TACATCCGACGGGTGAGGATGGCGCCCGGCGTCACTGTTACCAACTCGACAAAGCA<br>GAAGGACGAGCTCATCGTCGAAGGAAACAGCATAGAGGACGTGTCAAGATCAGCTG<br>CCCTCATCCAACAGTCAACAACAGTGAAGAACAAGGATATTCGTAAATTCTTGGAC |
| NL005 | SEQ ID NO: 1125<br>GGTCTGGTTGG<br>ATCCHAATGAAA<br>TCAAYGA | SEQ ID NO: 1126<br>TCCTGCTTCTTSGY<br>RGCRATWCGYTC | SEQ ID NO: 1079<br>TTGGATCCAATGAAATAAATGAAATCGCAAACACAAATTCACGTCAAAGCATCAGGA<br>AGCTGATCAAAGACGGTCTTATCATCAAGAAACCGGTTGCAGTACATTCACGTGCTCG<br>CGTTCGTAAAAACACTGAAGCCAGGAGGAAAGGCAGACATTGTGGCTTTGGTAAGAG<br>GAAAGGTACAGCCAACGCCCGTATGCCACAAAAGGTTCTATGGGTGAATCGTATGCG<br>TGTCTTGAGAAGACTGTTGAAAAAATACAGACAAGATAAGAAAATCGACAGGCATCTG<br>TACCATCACCTTTACATGAAGGCTAAGGGTAACGTATTCAAGAACAAGCGTGTATTGA<br>TGGAGTTCATTCATAAGAAGAAGGCCGAGAAAGCAAGAATGAAGATGTTGAACGACC<br>AGGCTGAAGCTCGCAGACAAAAGGTCAAGGAGGCCAAGAAGCGAAGGGAA |
| NL006 | SEQ ID NO: 1127<br>GGAGCGAGACT<br>ACAACAAYKAYR<br>GYTGGC | SEQ ID NO: 1128<br>GAGATCTTCTGCAC<br>RTTKACVGCATC | SEQ ID NO: 1081<br>AAGTGCTTGTGTCAAGTGGTGTGGTGGAGTACATTGACACCCTGGAGGAGGAGACG<br>ACCATGATAGCGATGTCGCCGGATGACCTGCGTCAGGACAAGGAGTATGCCTACTGT<br>ACCACCTACACGCACTGCAGATCCACCCGGCCATGATACTCGGTGTGTGCGCCTCT<br>ATTATTCCCTTCCCCGATCACAACCAAAGTCCCAGGAACACCTATCAGAGCGCTATGG<br>GGAAACAGGCGATGGGCGTGTACATCACCAACTTCCACGTGCGAATGGACACGCTG<br>GCTCACGTGCTGTTCTACCCGCACAAGCCACTGGTCACCACTCGCTCCATGGAGTAC<br>CTGCGCTTCAGGGAGCTTCCTGCCGGCATCAACTCTGTGGTCGCCATCGCCTGCTAC<br>ACTGGATACAACCAGGAGGACAGTGTCATTCTCAACGCCTCCGTCGAGCGCGG<br>ATTCTTCAGATCGGTTTTCTTCCGATCTTACAAAGATGCAGAATCGAAGCGTATTGGC<br>GACCAAGAGGAGCAATTCGAGAAGCCCACCAGACAGACGTGTCAGGGAATGAGGAA<br>TGCCATTTATGACAAATTGGACGATGATGGCATCATTGCTCCCGGTCGAGAGTGTCT<br>GGTGACGATGTGGTTATTGGCAAAACCATAACACTGCCCGATAATGATGACGAGCTG<br>GAAGGTACAACAAAGAGGTTCACGAAGAGAGATGCCAGTACTTTCCTGCGTAACAGT<br>GAGACGGGAATCGTCGACCAAGTCATGTTAACCTGAACTCTGAGGGTTACAAGTTC<br>TGCAAAATTCGAGTCAGGTCTGTGCGTATCCCGCAGATTGGCGATAAGTTCGCTTCC<br>CGACATGGCCAAAAAGGAACGTGTGGAATACAGTATCGTCAAGAGGACATGCCTTTT<br>ACAAGCGAGGGAATCGCACCGGATATTATTATCAATCCTCACGCTATCCCATCTCGTA<br>TGACAATTGGCCATTTAATTGAATGTCTCCAAGGAAAGGTGTCGTCGAACAAGGGCG<br>AGATAGGTGACGCGACGCCGTTCAAC |
| NL007 | SEQ ID NO: 1129<br>CGGTGTCCATTC<br>ACAGYTCCGG | SEQ ID NO: 1130<br>CGATGCAAGTAGG<br>TGTCKGARTCYTC | SEQ ID NO: 1083<br>TTTCAGAGATTTCCTTCTGAAACCTGAAATTTTGAGAGCAATCCTTGACTGTGGTTTTG<br>AACATCCATCTGAAGTACAACATGAATGCATTCCTCAAGCTGTACTTGGAATGGACAT<br>ATTGTGTCAAGCGAAATCCGGTATGGGAAAAACTGCTGTATTTGTGTTGGCGACATTA<br>CAGCAAATTGAACCAACTGACAACCAAGTCAGTGTATTGGTCATGTGTCATACCAGAG<br>AGCTTGCATTCCAAATCAGCAAAGATGTGAACGATTTTCGAAATGTATGCCAAATAT<br>CAAGGTTGGAGTTTTCTTCGGCGGACTGCCGATTCAGAGGGATGAGGAGACGTTGAA<br>ATTGAACTGTCCTCACATCGTGGTTGGAACACCCGGACGAATTTTGGCGTTGGTACG<br>CAACAAGAAGCTGGACCTCAAGCATCTCAAGCACTTTGTCCTTGACAATGTGACAAA<br>ATGTTGGAACTGTTAGATATGCGAAGAGATGTGCAGGAAATATTCCGAAACACGCCG<br>CACAGCAAACAAGTCATGATGTTCAGTGCAACTCTCAGCAAAGAAATTCGTCCAGTCT<br>GCAAGAAATTCATGCAAGATCCGATGAAGTGTACGTTGATGACGAGGCCAAGCTGA<br>CGCTTCACGGCCTGCAGCAGCACTATGTCAAACTCAAAGAAAACGAAAAGAACAAAA<br>AGTTATTTGAATTACTTGACATACTTGAATTCAACCAGGTTGTTATATTTGTGAAGTCA<br>GTGCAGCGCTGCATGGCCCTATCGCAACTCCTAACAGAGCAGAACTTCCCTGCAGTG<br>GCTATTCACCGTGCATGACACAAGAAGAACGATTGAAGAAATATCAAGAGTTCAAAG<br>AGTTCCTAAAGCGAATTTTGGTAGCAACGAATCTGTTTGGCAGAGGAATGGATATTGA<br>GAGAGTCAACATTGTATTCAACTATGACATGCCT |
| NL008 | SEQ ID NO: 1131<br>GTGGTGGATCA<br>CTTYAAYCGKAT<br>G | SEQ ID NO: 1132<br>GCGCATTTGATCGT<br>TBGTYTTCAC | SEQ ID NO: 1085<br>GGAAGATAGAAACCAGAAACGAGTTGTTGGTGTTCTTTTGGGATGCTGGAGACCT<br>GGAGGTGTATTAGATGTTTCAAACAGTTTTGCAGTTCCATTTGATGAGGACGACAAAG<br>AAAAGAATGTTTGGTTCTTAGACCATGATTACTTGGAAAACATGTTCGGGATGTTCAA<br>GAAAGTTAATGCTAGAGAAAGGTTGTGGGTTGGTACCATACTGGACCCAAACTCCA<br>CCAAAACGATGTTGCAATCAATGAGTTGATTCGTCGTTACTGTCCAAACTGTGTCTTA<br>GTCATAATCGATGCCAAGCCTAAAGATTTGGGTCTACCTACAGAGGCATACAGAGTC<br>GTTGAAGAAATCCATGATGATGGATCGCCAACATCAAAACATTTGAACATGTGATGA<br>GTGAGATTGGGGCAGAAGAGGCTGAGGAGATTGGCGTTGAACATCTGTTGAGAGAC<br>ATCAAAGATACAACAGTCGGGTCACTGTCACAGCGCGTCACAAATCAGCTGATGGGC<br>TTGAAGGGCTTGCATCTGCAATTACAGGATATGCGAGACTATTTGAATCAGGTTGTCG<br>AAGGAAAGTTGCCAATGAACCATCAAATCGTTTACCAACTGCAAGACATCTTCAACCT<br>TCTACCCGATATCGGCCACGGCAATTTTGTAGACTCGCTCTAC |

TABLE 2-NL-continued

| Target ID | Primer Forward 5' → 3' | Primer Reverse 5' → 3' | cDNA Sequence (sense strand) 5' → 3' |
|---|---|---|---|
| NL009 | SEQ ID NO: 1133<br>GGGCCGTGGTC<br>AGAAYATYWAYA<br>AC | SEQ ID NO: 1134<br>CCGCCAAAGGACT<br>SARRTADCCCTC | SEQ ID NO: 1087<br>TGCGACTATGATCGACCGCCGGGACGCGGTCAGGTGTGCGACGTCGACGTCAAGAA<br>CTGGTTTCCCTGCACCTCTGAGAACAATTTCAACTACCATCAATCGAGCCCTTGTGTT<br>TTTCTCAAACTGAACAAGATAATTGGTTGGCAACCGGAGTACTACAATGAGACTGAAG<br>GCTTTCCAGATAATATGCCAGGTGACCTCAAGCGACACATTGCCCAACAGAAGAGTA<br>TCAACAAGCTGTTTATGCAAACAATCTGGATAACTTGCGAAGGAGAGGGTCCTCTAGA<br>CAAGGAGAATGCAGGGGAGATCCAGTACATCCCTAGACAGGGATTTCCGGGCTACTT<br>CTACCCTTACACTAATGCC |
| NL010 | SEQ ID NO: 1135<br>CGGCTGACGTG<br>GAAYGTKTGGC<br>C | SEQ ID NO: 1136<br>TGCCGGAAGTTCTC<br>RTAYTCKGGC | SEQ ID NO: 1089 (amino terminus)<br>GTCCAGTCGACTGGAAGCCACCAGGCTTGTTGTTCCCGTTGGATGTCTGTATCAACC<br>TTTGAAGGAGAGACCTGATCTACCGCCTGTACAGTACGATCCAGTCTTTGTACTAGG<br>AATACTTGTCGTGCAATTCTGAATCCATTGTGCCAAGTCGACTATCGAGCCAAGCTAT<br>GGGTCTGCAACTTTTGTTTCCAGAGGAATCCTTTCCCCCCTCAATATGCAGCTATTTC<br>GGAGCAGCATCAACCAGCAGAACTGATACCTTCATTTTCCACCATCGAATACATCATT<br>ACCAGAGCGCAAACGATGCCGCCGATGTTCGTGCTGGTGGTGGACACATGTCTGGA<br>CGACGAGGAGCTGGGAGCTGGGTTGAAGGACTCACTGCAGATGTCGCTGTCGCTGCTGC<br>CGCCCAATGCACTCATCGGTCTCATCACGTTCGGCAAAATGGTGCAGGTGCACGAGC<br>TTGGCTGCGACGGCTGCTCGAAGAGCTACGTGTTCCGTGGCGTGAAGGACCTGACT<br>GCCAAGCAGATCCAGGACATGTTGGGCATTGGCAAGATGGCCGCCGCTCCACAGCC<br>CATGCAACAGCGCATTCCCGGCGCCGCTCCCTCCGCACCTGTCAACAGATTTCTTCA<br>GCCTGTCGGAAAGTGCGATATGAGTTTAACTGATCTGCTTGGGGAATTGCAAAGAGA<br>TCCATGGAATGTGGCTCAGGGCAAGAGACCTCTCCGATCTACTGGAGTTGCATTGTC<br>CATTGCAGTTGGTCTGCTCGAGTGCACA<br><br>SEQ ID NO: 1115 (carboxy terminus)<br>CGTTGAACGTGAAAGGCTCGTGTGTGTCAGACACTGACATTGGCTTGGGCGGCACCT<br>CTCAATGGAAAATGTGCGCCTTCACTCCACACACAACTTGTGCATTCTTCTTCGAAGT<br>TGTCAACCAGCACGCAGCCCCAATCCCACAGGGAGGAAGAGGATGCATCCAATTCAT<br>TACGCAATACCAACATTCCAGTGGCCAGAGAAGGATACGTGTCACCACCATCGCTCG<br>AAACTGGGCAGATGCGAGCACCAACCTGGCACACATCAGTGCCGGCTTCGACCAGG<br>AGGCAGGAGCCGTGCTGATGGCCCGCATGGTCGTGCATCGCGCCGAGACTGACGAT<br>GGACCTGACGTCATGCGCTGGGCTGACCGCATGCTCATCCGTCTCTGTCAGAGGTTC<br>GGTGAATACAGTAAGGATGACCCTAACAGTTTCCGTCTGCCAGAGAACTTCACACTTT<br>ATCCGCAGTTCATGTACCATCTGCGTCGATCCCAATTCTTGCAAGTGTTCAACAACAG<br>TCCTGATGAAACATCTTACTACAGGCACATTCTTATGCGAGAGGATCTGACTCAGAGT<br>TTGATTATGATCCAGCCGATTTTGTACAGCTACAGCTTCAATGGTCCCCCCGAGCCAG<br>TGCTGCTCGACACCAGCAGTATTCAACCCGACAGAATCCTATTGATGGCACATTTTT<br>CCAAATTCTCATTTTCCATGGAGAGACGATTGCTCAATGGCGATCTCTGGGCTACCAG<br>GACAT |
| NL011 | SEQ ID NO: 1137<br>CCCACTTTCAAG<br>TGYGTRTYTRGTC<br>GG | SEQ ID NO: 1138<br>CGCTCTCTCTCGAT<br>CTGYDSCTGCC | SEQ ID NO: 1091<br>AGATGGTGGTACCGGCAAAACTACATTTGTCAAACGACATCTTACCGGAGAATTTGAA<br>AAGAAGTATGTTGCCACCCTTGGAGTTGAAGTTCACCCCCTTGTATTTCACACAAACA<br>GAGGTGTGATTAGGTTCAATGTGTGGGACACAGCTGGCCAGGAAAAGTTCGGTGGA<br>CTTCGTGATGGATATTACATTCAGGGACAATGCGCCATCATTATGTTTGACGTAACGT<br>CAAGAGTCACCTACAAGAACGTTCCCAACTGGCACAGAGATTTAGTGAGGGTTTGCG<br>AAAACATTCCCATTGTACTATGCGGCAACAAAGTAGACATCAAGGACAGGAAAGTCAA<br>GGCCAAGAGCATAGTCTTCCATAGGAAGAAGAACCTTCAGTACTACGACATCAGTGC<br>GAAAAGCAACTACAACTTCGAGAAGCCGTTCCTGTGGTTGGCAAAGAAGCTGATCGG<br>TGACCCCAACCTGGAGTTCGTCGCCATGCCCGCCCTCCTCCCACCCGAGGTCACAAT<br>GGACCCCCAAT |
| NL012 | SEQ ID NO: 1139<br>GCAGGCGCAGG<br>TBGABGARGT | SEQ ID NO: 1140<br>GAATTTCCTCTTSA<br>GYTTBCCVGC | SEQ ID NO: 1093<br>GCAGCAGACGCAGGCACAGGTAGACGAGGTTGTCGATATAATGAAAACAAACGTTGA<br>GAAAGTATTGGAGAGGGATCAAAAACTATCAGAATTGGATGATCGAGCAGATGCTCTA<br>CAGCAAGGCGCTTCACAGTTTGAACAGCAAGCTGGCAAACTCAAGAGGAAATTC |
| NL013 | SEQ ID NO: 1141<br>CAGATGCGCCC<br>GTBGTDGAYAC | SEQ ID NO: 1142<br>GCCCTTGACAGAYT<br>GDATVGGATC | SEQ ID NO: 1095<br>CGCAGAGCAAGTCTACATCTCTTCACTGGCCTTATTGAAAATGCTTAAGCACGGTCGC<br>GCCGGTGTTCCCATGGAAGTTATGGGCCTAATGCTGGGCGAATTTGTAGACGACTAC<br>ACTGTGCGTGTCATTGATGTATTCGCTATGCCACAGAGTGGAACGGGAGTGAGTGTG<br>GAGGCTGTAGACCCGGTGTGTTCCAAGCGAAGATGTTGGACATGCTAAAGCAGACAGG<br>ACGGCCCGAGATGGTGGTGGGCTGGTACCACTCGCACCCGGGCTTCGGCTGCTGG<br>CTGTCGGGTGTCGACATCAACACGCAGGAGAGCTTCGAGCAACTATCCAAGAGAGC<br>CGTTGCCGTCGTCGTC |
| NL014 | SEQ ID NO: 1143<br>CGCAGATCAAR<br>CAYATGATGGC | SEQ ID NO: 1144<br>GAACTTGCGGTTGA<br>BGTTSCGDCC | SEQ ID NO: 1097<br>TTTCATTGAGCAAGAAGCCAATGAGAAAGCCGAAGAGATCGATGCCAAGGCCGAGGA<br>AGAATTCAACATTGAAAGGGAAGGCTCGTACAGCACCAGCGCCTTAAAATCATGGA<br>GTACTATGACGAGAAAGAAGCAGGTTGAGCTCCAGAAAAAAATCCAATCGTCAAA<br>CATGCTGAACCAAGCGCGTCTGAAGGCACTGAAGGTGCGCGAAGATCACGTGAGAA<br>GTGTGCTCGAAGAATCCAGAAAACGTCTTGGAGAAGTAACCAGAAACCCAGCCAAGT<br>ACAAGGAAGTCCTCCAGTATCTAATTGTCCAAGGACTCCTGCAGCTGCTAGAATCAAA<br>CGTAGTACTGCGCGTGCGCGAGGCTGACGTGAGTCTGATCGAGGGCATTGTTGGCT<br>CATGCGCAGAGCAGTACGCGAAGATGACCGGCAAAGAGGTGGTGGTGAAGCTGGAC |

TABLE 2-NL-continued

| Target ID | Primer Forward 5' → 3' | Primer Reverse 5' → 3' | cDNA Sequence (sense strand) 5' → 3' |
|---|---|---|---|
| | | | GCTGACAACTTCCTGGCCGCCGAGACGTGTGGAGGCGTCGAGTTGTTCGCCCGCAA CGGCCGCATCAAGATCCCCAACACCCTCGAGTCCAGGCTCGACCTCATCTCCCAGCA ACTTGTGCCCGAGATTAGAGTCGCGCTCTTT |
| NL015 | SEQ ID NO: 1145 GCCGCAAGGAG ACBGTVTGC | SEQ ID NO: 1146 GTCCGTGGGAYTC RGCHGCAATC | SEQ ID NO: 1099 ATTGTGCTGTCTGACGAGACATGTCCGTTCGAAAAGATCCGCATGAATCGAGTGGTC AGGAAGAATCTGCGAGTGCGCTTGTCCGACATTGTCTCGATCCAGCCTTGCCCAGAC GTCAAGTATGGAAAGCGTATCCATGTGCTGCCCATTGATGATACCGTTGAGGGTCTTA CAGGAAATCTGTTCGAAGTGTATTTGAAGCCATACTTCCTGGAAGCATACAGGCCAAT TCACAAGGATGATGCATTCATTGTTCGCGGAGGTATGAGAGCGGTCGAATTCAAGGT GGTTGAAACAGATCCATCGCCCTACTGCATTGTCGCGCCAGACACCGTCATCCATTG TGAGGGAGACCCCATCAAACGTGAGGATGAAGAAGACGCAGCAAACGCAGTCGGCT ACGACGACATTGGAGGCTGCAGAAAGCAGCTGGCGCAGATCAAAGAGATGGTGGAG TTGCCGCTGAGACATCCCAGTCTGTTCAAGGCGATCGGCGTGTGAGCGCCACGAGG CATCCTGCTGTACGGACCACCGGGAACCGGAAAGACGTTGATAGCGCGCGCCGTCG CCAACGAAACGGGCGCCTTCTTCTTCCTCATCAACGGACCCGAGATTATGAGCAAAT TGGCCGGCGAGTCGGAGAGTAACCTGCGCAAAGCTTTCGAGGAAGCGGACAAAAAC GCACCGGCCATCATCTTCATCGATGAGCTGGACGCAATCGCGCCAAAACGCGAGAA GACGCACGGCGAGGTGGAGCGACGCATCGTGTCGCAGCTGCTGACGCTGATGGAC GGTCTCAAGCAGAGCTCGCACGTGATTGTCATGGCCGCCACCAATCGGCCCAACTC GATCGATGCCGCGCTTAGGCGCTTTGGCCGCTTTGATCGCGAAATCGACATTGGCAT TCCCGATGCCACCGGTCGTCTCGAGGTGCTGCGCATCCACACCAAGAACATGAAGTT GGCTGATGACGTCGATTTGGAACA |
| NL016 | SEQ ID NO: 1147 GTTCACCGGCG AYATYCTGCG | SEQ ID NO: 1148 CGGCATAGTCAGA ATSGGRATCTG | SEQ ID NO: 1101 GACGCCAGTATCAGAAGACATGCTTGGTCGTGTATTCAACGGAAGTGGTAAGCCCAT CGACAAAGGACCTCCCATTCTTGCTGAGGATTATCTCGACATTCAAGGTCAACCCATC AATCCTTGGTCGCGTATCTATCCCGAGGAAATGATCCAGACTGGAATTTCAGCCATCG ACGTCATGAACTCGATTGCTCGTGGCCAGAAAATCCCCATCTTTTCAGCTGCCGGTCT ACCTCACAACGAAATTGCTGCTCAAATCTGTAGACAGGCTGGTCTTGTCAAACTGCCA GGAAAGTCAGTTCTCGATGACTCTGAGGACAACTTTGCTATTGTATTCGCAGCCATGG GAGTCAACATGGAAACTGCTCGATTCTTCAAACAGGATTTCGAGGAGAACGGCTCTAT GGAGAACGTGTGCCTGTTCTTGAACCTGGCGAACGACCCGACGATCGAGCGTATCAT CACACCACGCCTGGCGCTGACGGCCGCCGAGTTCCTGGCCTACCAGTGCGAGAAGC ACGTGCTCGTCATCCTCACCGACATGAGCTCCTACGCCGAGGCGCTGCGAGAGGTG TCCGCCGCCCGCGAGGAGGTGCCCGGCCGTCGTGGTTTCCCCGGTTACATGTACAC CGATCTGGCCACCATCTACGAGCGCGCCGGACGAGTCGAGGGTCGCAACGGCTCCA TCACG |
| NL018 | SEQ ID NO: 1149 GCTCCGTCTACA THCARCCNGAR GG | SEQ ID NO: 1150 GTGCATCGGTACC AHSCHGCRTC | SEQ ID NO: 1103 TATGCAAATGCCTGTGCCACGCCCACAAATAGAAAGCACACAACAGTTTATTCGATCC GAGAAAACAACATACTCGAATGGATTCACCACCATTGAGGAGGACTTCAAAGTAGACA CTTTCGAATACCGTCTTCTGCGCGAGGTGTCGTTCCGCGAATCTCTGATCAGAAACTA CTTGCACGAGGCGGACATGCGATGTCGACGGTGGTGGACCGAGCATTGGGTCCCC CCTCGGCGCCACACATCCAGCAGAAGCCGCGCAACTCAAAAATCCAGGAGGGCGGC GATGCCGTCTTTTCCATCAAGCTCAGCGCCAACCCCAAGCCTCGGCTGGTCTGGTTC AAGAACGGTCAGCGCATCGGTCAGACGCAGAGAAACACCAGGCCTCTCCTACTCCAATCAG ACCGCCACGCTCAAGGTCAACAAAGTCAGCGCTCAAGACTCCGGCCACTACACGCT GCTTGCTGAAAATCCGCAAGGATGTACTGTGTCCTCAGCTTACCTAGCTGTCGAATCA GCTGGCACTCAAGATACAGGATACAGTGAGCAATACAGCAGACAAGAGGTGGAGAC GACAGAGGCGGTGGACAGCAGCAAGATGCTGGCACCGAACTTTGTTCGCGTGCCGG CCGATCGCGACGCGAGCGAAGGCAAGATGACGCGGTTTGACTGCCGCGTGACGGG CCGACCCTACCCGGACGTGGCCTGGTTCATCAACGGCCAACAGGTGGCTGACGACG CCACGCACAAGATCCTCGTCAACGAGTCTGGCAACCACTCGCTCATGATCACCGGCG TCACTCGCTTGGACCACGGAGTGGTCGGCTGTATTGCCCGCAACAAGGCTGGCGAA ACCTCATTCCAGTGCAACTTGAATGTGATCGAGAAAGAACTGGTTGTGGCGCCGAAA TTTGTGGAGAGATTCGCACAAGTGAATGTGAAGGAGGGTGAGCCGGTTGTGCTGAG CGCACGCGCTGTTGGCACACCTGTTCCAAGAATAACATGGCAGAAGGACGGCGCCC CGATCCAGTCGGGACCGAGCGTGAGTCTGTTTGTGGACGGAGGTGCGACCAGCCTG GACATCCCGTACGCGAAGGCGTCG |
| NL019 | SEQ ID NO: 1151 GTCCTGTCTGCT GCTVMGWTTYG C | SEQ ID NO: 1152 CCTTGATCTCHGC MGCCATBGTC | SEQ ID NO: 1105 CGATGACACATACACAGAAAGTTACATCAGTACCATTGGTGTAGATTTTAAAATTAGAA CAATAGATCTCGATGGAAAAACCATAAAGCTTCAGATTTGGGACACGGCCGGCCAGG AGCGGTTCCGCACGATCACATCGAGCTACTACCGGGGCGCCCACGGCATCATTGTG GTGTATGACTGCACCGACCAGGAGTCGTTCAACAACCTCAAACAGTGGCTCGAGGA GATTGACCGCTACGCCTGTGATAATGTCAACAAACTGCTCGTCGGCAACAAGTGTGA TCAGACCAACAAAAAGGTCGTCGACTATACACAGGCTAAGGAATACGCCGACCAGCT GGGCATTCCGTTCCTGGAGACGTCGGCGAAGAACGCGACCAATGTGGAGCAGGCGT TCAT |
| NL021 | SEQ ID NO: 1153 CTCAATCAGAGC GTYCCHCCRTAY GG | SEQ ID NO: 1154 GGAATTGCCSAGV CGDGADCC | SEQ ID NO: 1107 CGTCAGTCTCAATTCTGTCACCGATATCAGCACCACGTTCATTCTCAAGCCACAAGAG AACGTGAAGATAACGCTTGAGGGCGCACAGGCCTGTTTCATTTCACACGAACGACTT GTGATCTCACTGAAGGGAGGAGAACTCTATGTTCTAACTCTCTATTCCGATAGTATGC GCAGTGTGAGGAGTTTTCATCTGGAGAAAGCTGCTGCCAGTGTCTTGACTACTTGTAT CTGTGTTTGTGAGGAGAACTATCTGTTCCTTGGTTCCCGTCTTGGAAACTCACTGTTG |

TABLE 2-NL-continued

| Target ID | Primer Forward 5' → 3' | Primer Reverse 5' → 3' | cDNA Sequence (sense strand) 5' → 3' |
|---|---|---|---|
| | | | CTCAGGTTTACTGAGAAGGAATTGAACCTGATTGAGCCGAGGGCCATCGAAAGCTCA CAGTCCCAGAATCCGGCCAAGAAGAAAAAGCTGGATACTTTGGGAGATTGGATGGCA TCTGACGTCACTGAAATACGCGACCTGGATGAACTAGAAGTGTATGGCAGTGAAACA CAAACCTCTATGCAAATTGCATCCTACATATTC |
| NL022 | SEQ ID NO: 1155 GCGTGCTCAAG TAYATGACBGAY GG | SEQ ID NO: 1156 CCAGTTCATGCTTR TANGCCCANGC | SEQ ID NO: 1109 TACATTGCACAGAGAATTCCTTTCCGAGCCAGATCTGCAATCTTACAGTGTTATGATA ATTGATGAAGCTCACGAGAGGACGTTGCACACTGATATACTGTTCGGTTTGGTGAAA GATGTCGCCCGATTCAGACCTGACTTGAAGCTGCTCATATCAAGCGCCACACTGGAT GCTCAGAAATTCTCCGAGTTTTTCGACGATGCACCCATCTTCAGGATTCCGGGCCGT AGATTTCCGGTGGACATCTACTACACAAAGGCGCCCGAGGCTGACTACGTGGACGCA TGTGTCGTTTCGATCCTGCAGATCCACGCCACTCAGCCGCTGGGAGACATCCTGGTC TTCCTCACCGGTCAGGAGGAGATCGAAACCTGCCAGGAGCTGCTGCAGGACAGAGT GCGCAGGCTTGGGCCTCGTATCAAGGAGCTGCTCATATTGCCCGTCTATTCAACCT ACCCAGTGTATATGCAGGCAAAGATTTTCCTGCCCACTCCACCAAATGCTAGAAAGGTA GTATTGGCCACAAATATTGCAGAAACCTCATTGACCATCGACAATATAATCTACGTGA TTGATCCTGGTTTTTGTAAGCAGAATAACTTCAATTCAAGGACTGGAATGGAATCGCT TGTTGTAGTGCCTGTTTCAAAGGCATCGGCCAATCAGCGAGCAGGGCGGGCGGGAC GGGTGGCGGCCGGCAAGTGCTTCCGTCTGTACACG |
| NL023 | SEQ ID NO: 1157 CCGGAGCTTCT CTCAGGAACGC | SEQ ID NO: 1158 GAAAGCACACGCT GTTGCTCTGG | SEQ ID NO: 1111 CCGGAGCTTCTCTCAGGAACGCCAGCACGAGGAAATGAAGGAATCCTCGGGTCGCA TGCATCACAGCGATCCTCTAATCGTCGAGACTCATAGCGGTCACGTGAGAGGAATCT CGAAGACCGTCCTCGGACGGGAGGTCCACGTGTTTACCGGGATTCCGTTTGCGAAA CCTCCCATCGGTCCGTTGCGATTCCGTAAACCGGTTCCCGTCGACCCGTGGCACGG CGTTCTGGATGCGACCGCGCTTCCCAACAGCTGCTACCAGGAACGGTACGAGTATTT CCCGGGCTTCGAGGGAGGAGGAAATGTGGAATCCGAATACGAATTTGTCGAAGATTG TCTGTATTTGAACATATGGGTGCCGCACCGGTTGAGAATCCGACACAGAGCCAACAG CGAGGAGAATAAACCAAGAGCGAAGGTGCCGGTGCTGATCTGGATCTACGGCGGGG GTTACATGAGCGGCACAGCTACACTGGACGTGTACGATGCTGACATGGTGGCCGCC ACGAGTGACGTCATCGTCGCCTCCATGCAGTACCGAGTGGGTGCGTTCGGCTTCCTC TACCTCGCACAGGACTTGCCTCGAGGCAGCGAGGAGGCGCCGGGCAACATGGGGC TCTGGGACCAGGCCCTTGCCATCCGCTGGCTCAAGGACAACATTGCCGCCTTCGGA GGCGATCCCGAACTCATGACGACTCTTTGGCGAGTCGGCTGGGGGTGGATCTGTAAG CATCCACTTGGTATCACCGATAACTCGCGGCCTAGCGCGTCGTGGCATCATGCAGTC AGGAACGATGAACGCACCGTGGAGCTTCATGACGGCGGAACGCGCGACCGAAATCG CCAAGAGCGCTCATTGACGACTGCGGCTGCAACTCGTCGCTCCTGACCGACGCTCCC AGTCGCGTCATGTCCTGTATGCGATCAGTCGAGGCAAAGATCATCTCCGTGCAGCAA TGGAACAGCTACTCCGGCATTCTCGGACTTCCGTCTGCACCCACCATCGACGGCATT TTCCTGCCCAAACATCCCCTCGATCTGCTCAAGGAAGGCGACTTTCAGGACACTGAA ATACCTCATCGGCAGTAATCAGGATGAGGGTACCTACTTCATATTGTACGATTTCATCG ACTTCTTCCAAAAAGACGGGCCGAGTTTCTTGCAAAGAGATAAGTTCCTAGACATCAT CAACACAATTTTCAAGAATATGACGAAAATTGAGAGGGAAGCTATCATATTCCAGTAC ACAGATTGGGAGCATGTTATGGATGGTTATCGAACCAGAAAATGATCGGAGATGTG GTTGGTGATTACTTCTTCATCGTCCGACAAATCATTTCGCACAGGCATTCGCAGAGC ATGGAAAGAAGGTGTATTACTATTTCTTCACCCAGAGAACCAGTACAAGTTTATGGGG CGAGTGGATGGGAGTCATGCATGGAGATGAAATAGAATACGTTTTTGGTCATCCTCTC AACATGTGCTGCAATTCAATGCTAGGGAAAGGGATCTCAGTCTGCGAATAATGCAA GCTTACTCTAGGTTTGCATTGACAGGTAAACCAGTGCCTGATGACGTGAATTGGCCTA TCTACTCCAAGGACCAGCCGCAGTATTACATTTTCAATGCGGAGACTTCGGGCACAG GCAGAGGACCCAGAGCAACAGCGTGTGCTTTC |
| NL027 | SEQ ID NO: 1159 GCCGATCGTKYT VACKGGCTC | SEQ ID NO: 1160 GGTATAGATGAARC ARTCDCCVACCCA | SEQ ID NO: 1113 AGAAGACGGCACGGTGCGTATTTGGCACTCGGGCACCTACAGGCTGGAGTCCTCGC TGAATTATGCCTCGAAAGAGTGTGGACCATTTGCTGCATGCGAGGATCCAACAATG TGGCTCTTGGCTACGACGAAGGCAGCATAATGGTGAAGGTGGGTCGGGAGGAGCCG GCCATCTCGATGGATGTGAACGGTGAGAAGATTGTGTGGGCGCGCCACTCGGAGAT ACAACAGGTCAACCTCAAGGCCATGCCGGAGGGCGTCGAAATCAAAGATGGCGAAC GACTGCCGGTCGCCGTTAAGGATATGGGCAGCTGTGAAATATATCCGCAGACCATCG CTCATAATCCCAACGGCAGATTCCTAGTCGTTTGTGGAGATGGAGAGTACATAATTCA CACATCAATGGTGCTAAGAAATAAGGCGTTTGGCTCGGCCCAAGAGTTCATTTGGGG ACAGGACTCGTCCGAGTATGCTATCAGAGAAGGAACATCCACTGTCAAAGTATTCAAA AACTTCAAAGAAAAGAAATCATTCAAGCCAGAATTTGGTGCTGAGAGCATATTCGGCG GCTACCTGCTGGGAGTTTGTTCGTTGTCTGGACTGGCGCTGTACGACTGGGAGACCC TGGAGCTGGTGCGTCGCATCGAGATCCAACCGAAACACGTGTACTGGTCGGAGAGT GGGGAGCTGGTGGCGCTGGCCACTGATGACTCCTACTTTGTGCTCCGCTACGACGC ACAGGCCGTGCTCGCTGCACGCGACGCCGGTGACGACGCTGTCACGCCGGACGGC GTCGAGGATGCATTCGAGGTCCTTGGTGAAGTGCACGAAACTGTAAAAACTGGATTG |

TABLE 2-CS

| Target ID | Primer Forward 5' → 3' | Primer Reverse 5' → 3' | cDNA Sequence (sense strand) 5' → 3' |
|---|---|---|---|
| CS001 | SEQ ID NO: 1706 CATTTGAAGCGT TTWRMYGCYCC | SEQ ID NO: 1707 CTTCGTGCCCTT GCCRATKATRAA BACG | SEQ ID NO: 1682 TAAAGCATGGATGTTGGACAAACTGGGTGGCGTGTACGCGCCGCGGCCGTCGACCGG CCCCCACAAGTTGCGCGAGTGCCTGCCGCTGGTGATCTTCCTCAGGAACCGGCTCAA GTACGCGCTCACCGGAAATGAAGTGCTTAAGATTGTAAAGCAGCGACTTATCAAAGTTG ACGGCAAAGTCAGGACAGACCCCACATATCCCGCTGGATTTATGGATGTTGTTTCCATT GAAAAGACAAATGAGCTGTTCCGTCTTATATATGATGTCAAAGGCAGATTTACTATTCAC CGTATTACTCCTGAGGAGGCTAAATACAAGCTGTGCAAGGTGCGGCGCGTGGCGACG GGCCCCAAGAACGTGCCTTACCTGGTGACCCACGACGGACGCACCGTGCGATACCCC GACCCACTCATCAAGGTCAACGACTCCCATCCAGCTCGACATCGCCACCTCCAAGATCA TGGACTTCATCAAGTTTGAATCTGGTAACCTATGTATGATCACGGGAGGCCGTAACTTG GGGCGCGTGGGCACCATCGTGTCCCGCGAGCGACATCCCGGGTCCTTCGACATCGTG CATATACGGGACTCCACCGGACATACCTTCGCTACCAGATTGAACAACGTGTTCATAAT CGGCAAGGGCACGAAG |
| CS002 | SEQ ID NO: 1708 GAGTTTCTTTAG TAAAGTATTCGG TGG | SEQ ID NO: 1709 GCAATGTCATCC ATCAKRTCRTGTA C | SEQ ID NO: 1684 GAGTTTCTTTAGTAAAGTATTCGGTGGCAAGAAGGAGGAGAAGGGTCCATCAACACAC GAAGCTATACAGAAATTACGCGAAACGGAAGAGTTATTGCAGAAGAAACAAGAGTTTCT AGAGCGAAAGATCGACACTGAATTACAAACGGCGAGAAAACATGGCACAAAGAATAAG AGAGCTGCCATTGCGGCACTGAAGCGCAAGAAGCGTTATGAAACAGCAGCTTACCCAGA TTGATGGCACGCTTACCCAAATTGAGGCCCAAAGGGAAGCGCTAGAAGGAGCTAACAC CAATACACAGGTGCTTAACACTATGCGAGATGCTGCTACCGCTATGAGACTCGCCCAC AAGGATATCGATGTAGACAAGGTACACGATCTGATGGATGACATTGC |
| CS003 | SEQ ID NO: 1710 CAGGGAGTTGAR RATHATYGGHSA RTA | SEQ ID NO: 1711 CAGGTTCTTCCT CTTKACRCGDCC | SEQ ID NO: 1686 TGGTCTCCGCAACAAGCGTGAGGTGTGGAGGGTGAAGTACACGCTGGCCAGGATCCG TAAGGCTGCCCGTGAGCTGCTCACACTCGAGGAGAAAGACCCTAAGAGGTTATTCGAA GGTAATGCTCTCCTTCGTCGTCTGGTGAGGATCCGGTGTTGTTGGATGAAGCAGATGA AGCTCGATTATGTACTCGGTCTGAAGATTGAGGACTTCTTGGAACGTCGTCTCCAGACT CAGGTGTTCAAGGCTGGTCTAGCTAAGTCTATCCATCATGCCCGTATTCTTATCAGACA GAGGGCACATCCGTGTCCGCAAGCAAGTTGTGAACATCCCTTCGTTCATCGTGCGGCTG GACTCTGGCAAGCACATTGACTTCTCGCTGAAGTCTCCGTTCGGCGGCGGCCGGCCG |
| CS006 | SEQ ID NO: 1712 ACCTGCCAAGG AATGMGVAAYG C | SEQ ID NO: 1713 GAGATCTTCTGC ACRTTKACVGCAT C | SEQ ID NO: 1688 ACCTGCCAAGGAATGAGGAACGCTTTGTATGACAAATTGGATGATGATGGTATAATTGC ACCAGGGATTCGTGTATCTGGTGACGATGTAGTCATTGGAAAAACTATAACTTTGCCAG AAAACGATGATGAGCTGGAAGGAACATCAAGACGATACAGTAGAGAGAATGCCTCTAC ATTCTTGCGAAACAGTGAAATGGTATTGTTGACCAAGTTATGCTTACACTTAACAGCG AAGGATACAAATTTTGTAAAATACGTGTGAGATCTGTGAGAATCCCACAAATTGGAGAC AAATTTGCTTCTCGTCATGGTCAAAAAGGGACTTGTGGTATTCAATATAGGCAAGAAGA TATGCCTTTCACTTGTGAAGGATTGACACCAGATATTATCATCAATCCACATGCTATCCC CTCTCGTATGACAATTGGTCACTTGATTGAATGTATTCAAGGTAAGGTCTCCTCAAATAA AGGTGAAATAGGTGATGCTACACCATTTAACGATGCTGTCAACGTGCAGAAGATCTC |
| CS007 | SEQ ID NO: 1714 CGGTGTCCATTC ACAGYTCCGG | SEQ ID NO: 1715 CGATGCAAGTAG GTGTCKGARTCY TC | SEQ ID NO: 1690 TTTCAGAGATTCTTGTTGGAACCAGAGATTTTGGGGGCTATCGTCGATTGCGGTTTCG AGCACCCTTCAGAAGTTCAACATGAATGTATTCCCAAGCTGTTTTGGGAATGGATATT CTTTGTCAAAGCTAAATCCGGAATGGGAAAAACCGCCGTATTTGTTTTAGCAACACTGC AACAGCTAGAACCTTCAGAAAACCATGTTTACGTATTAGTAATGTGCCATACAAGGGAA CTCGCTTTCCAAATAAGCAAGGAATATGAGAGGTTCTCTAAATATATGGCTGGTGTTAG AGTATCTGTATTCTTTGGTGGGATGCCAATTCAGAAAGATGAAGAAGTATTGAAGACAG CCTGCCCGCACATCGTTGTTGGTACTCCTGGCAGAATATTAGCATTGGTTAACAACAAG AAACTGAATTTAAAACACCTGAAACACTTCATCCTGGATGAATGTGACAAAATGCTTGAA TCTCTAGACATGAGACGTGATGTGCAGGAAATATTCAGGAACACCCCTCACGGTAAGC AGGTCATGATGTTTTCTGCAACATTGAGTAAGGAGATCAGACCAGTCTGTAAGAAATTT ATGCAAGATCCTATGGAAGTTTATGTGGATGATGAAGCTAAACTTACATTGCACGGTTT GCAGCAACATTATGTTAAACTCAAGGAAAATGAAAAGAATAAGAAGTTATTTGAACTTTT GGATGTACTGGAGTTCAACCAAGTTGTCATATTTGTAAAGTCAGTGCAGCGCTGCATAG CTCTCGCACAGCTGCTGACAGACCAAAACTTCCCAGCTATTGGTATACACCGAAATATG ACTCAAGATGAGCGTCTCTCCCGCTATCAGCAGTTCAAAGATTTCCAGAAGAGGATCCT TGTTGCGACAAATCTTTTTGGACGGGGTATGGACATTGAAAGAGTCAACATAGTCTTCA ATTATGACATGCCG |
| CS009 | SEQ ID NO: 1716 CCTCGTTGCCAT YTGYWTKTGG | SEQ ID NO: 1717 CTGGATTCTCTC CCTCGCAMGAHA CC | SEQ ID NO: 1692 CCTCGTTGCCATTTGTATTTGGACGTTTCTGCAGCGGCTGGACTCACGGGAGCCCATG TGGCAGCTGGACGAGAGCATCATCGGCACCAACCCCGGGCTCGGCTTCCGGCCCACG CCGCCAGAGGTCGCCAGCAGCGTCATCTGGTATAAAGGCAACGACCCCAACAGCCAA CAATTCTGGGTGCAAGAAACCTCCAACTTTCTAACCGCGTACAAACGAGACGGTAAGA AAGCAGGAGCAGGCCAGAACATCCACAACTGTGATTTCAAACTGCCTCCTCCGGCCGG TAAGGTGTGCGACGTGGACATCAGCGCCTGGAGTCCCTGTGTAGAGGACAAGCACTTT GGATACCACAAGTCCACGCCCTGCATCTTCCTCAAACTCAACAAGATCTTCGGCTGGA GGCCGCACTTCTACAACAGCTCCGACAGCCTGCCCACTGACATGCCCGACGACTTGAA GGAGCACATCAGGAATATGACAGCGTACGATAAGAATTATCTAAACATGGTATGGGTGT CTTGCGAGGGAGAGAATCCAG |
| CS011 | SEQ ID NO: 1718 GGCTCCGGCAA GACVACMTTYGT C | SEQ ID NO: 1719 GTGGAAGCAGGG CWGGCATKGCRA C | SEQ ID NO: 1694 GGCTCCGGCAAGACGACCTTTGTCAAACGACACTTGACTGGAGAGTTCGAGAAAAGAT ATGTCGCCACATTAGGTGTCGAGGTGCATCCCTTAGTATTCCACACAAATAGAGGCCCT ATAAGGTTTAATGTATGGGATACTGCTGGCCAAGAAAAGTTTGGTGGTCTCCGAGATG |

TABLE 2-CS-continued

| Target ID | Primer Forward 5' → 3' | Primer Reverse 5' → 3' | cDNA Sequence (sense strand) 5' → 3' |
|---|---|---|---|
| | | | GTTACTATATCCAAGGTCAATGTGCCATCATCATGTTCGATGTAACGTCTCGTGTCACC<br>TACAAAAATGTACCCAACTGGCACAGAGATTTAGTGCGAGTCTGTGAAGGCATTCCAAT<br>TGTTCTTTGTGGCAACAAAGTAGATATCAAGGACAGAAAAGTCAAAGCAAAAACTATTG<br>TTTTCCACAGAAAAAAGAACCTTCAGTATTATGACATCTCTGCCAAGTCAAACTACAATT<br>TCGAGAAACCCTTCCTCTGGTTAGCGAGAAAGTTGATCGGTGATGGTAACCTAGAGTTT<br>GTCGCCATGCAGCCCTGCTTCCAC |
| CS013 | SEQ ID NO: 1720<br>GGATCGTCTGC<br>TAMGWYTWGGA<br>GG | SEQ ID NO: 1721<br>CTATGGTGTCCA<br>GCATSGCGC | SEQ ID NO: 1696<br>CAGATGCGCCCGTTGTTGATACTGCCGAACAGGTATACATCTCGTCTTTGGCCCTGTT<br>GAAGATGTTAAAACACGGGCGCGCCGGTGTTCCAATGGAAGTTATGGGACTTATGTTA<br>GGTGAATTTGTTGATGATTACACGGTGCGTGTCATAGACGTATTTGCCATGCCTCAAAC<br>TGGCACAGGAGTGTCGGTTGAAGCTGTAGATCCTGTCTTCCAAGCAAAGATGTTGGAT<br>ATGTTGAAGCAAACTGGACGACCTGAGATGGTAGTGGGATGGTACCACTCGCATCCTG<br>GCTTTGGATGTTGGTTATCTGGAGTCGACATTAATACTCAGCAGTCTTTCGAAGCTTTG<br>TCTGAACGTGCTGTAGCTGTAGTGGTTGATCCCATTCAGTCTGTCAAGGGC |
| CS014 | SEQ ID NO: 1722<br>ATGGCACTGAG<br>CGAYGCHGATG | SEQ ID NO: 1723<br>GAACTTGCGGTT<br>GABGTTSCGDCC | SEQ ID NO: 1698<br>TTCAAAAGCAATCAAGCATATGATGGCCTTCATCGAACAAGAGGCTAATGAAAAGGCC<br>GAGGAAATCGATGCAAAGGCCGAAGAGGAGTTCAACATTGAAAAAGGCCGCCTGGTG<br>CAGCAGCAGCGGCTCAAGATCATGGAATACTACGAAAAGAAAGAGAAACAAGTGGAAC<br>TCCAGAAAAAGATCCAATCTTCGAACATGCTGAATCAAGCCCGTCTGAAGGTGCTCAAA<br>GTGCGTGAGGACCACGTACGCAACGTTCTCGACGAGGCTCGCAAGCGCCTGGCTGAG<br>GTGCCCAAAGACGTGAAACTTTACACAGATCTGCTGGTCACGCTCGTCGTACAAGCCC<br>TATTCCAGCTCATGGAACCCACAGTAACAGTTCGCGTTAGGCAGGCGGACGTCTCCTT<br>AGTACAGTCCATATTGGGCAAGGCACAGCAGGATTACAAAGCAAAGATCAAGAAGGAC<br>GTTCAATTGAAGATCGACACCGAGAATTCCCTGCCCGCCGATACTTGTGGCGGAGTGG<br>AACTTATTGCTGCTAGAGGGCGTATTAAGACTCAGCAACACTCTGGAGTCTCGTCTGGA<br>GCTGATAGCCCAACAACTGTTGCCCGAAATACGTACCGCATTGTTC |
| CS015 | SEQ ID NO: 1724<br>GCCGCAAGGAG<br>ACBGTVTGC | SEQ ID NO: 1725<br>CGATCAAAGCGW<br>CCRAAVCGACG | SEQ ID NO: 1700<br>ATCGTGCTTTCAGACGATAACTGCCCCGATGAGAAGATCCGCATGAACCGCGTCGTGC<br>GAAACAACTTGCGTGTACGCCTGTCAGACATAGTCTCCATAGCGCCTTGTCCATCGGT<br>CAAATATGGGAAACGGGTACATATATTGCCCATTGATGATTCTGTCGAGGGTTTGACTG<br>GAAATTTATTCGAAGTCTACTTGAAACCATACTTCATGGAAGCTTATCGGCCTATCCATC<br>GCGATGACACATTCATGGTTCGCGGGGGCATGAGGGCTGTTGAATTCAAAGTGGTGA<br>GACTGATCCGTCGCCGTATTGCATCGTCGCTCCCGACACAGTGATACACTGCGAAGGA<br>GACCCTATCAAACGAGAGGAAGAAGAAGAAGCCCTAAACGCCGTAGGGTACGACGAC<br>ATCGGTGGCTGTCGTAAACAGCTCGCTCAGATCAAAGAGATGGTCGAGTTGCCTCTAA<br>GGCATCCGTCGCTGTTCAAGGCAATTGGTGTGAAGCCGCCACGTGGAATCCTCATGTA<br>TGGGCCGCCTGGTACCGGCAAAACTCTCATTGCTCGGGCAGTGGCTAATGAAACTGGT<br>GCATTCTTCTTTCTGATCAACGGGCCGGAGATCATGTCCAAACTCGCGGGCGAGTCCG<br>AATCGAACCTTCGCAAGGCATTCGAGGAAGCGGACAAGAACTCCCCGGCTATAATCTT<br>CATCGATGAACTGGATGCCATCGCACCAAAGAGGGAGAAGACTCACGGTGAAGTGGA<br>GCGTCGTATTGTGTCGCAACTACTTACTCTTATGGATGGAATGAAGAAGTCATCGCACG<br>TGATCGTAATGGCCGCCACCAACCGTCCGAATTCGATCGACCCGGCGCTA |
| CS016 | SEQ ID NO: 1726<br>GTTCACCGGCG<br>AYATYCTGCG | SEQ ID NO: 1727<br>GTCGCGCAGGTA<br>GAAYTCKGC | SEQ ID NO: 1702<br>AGGATGGAAGCGGGGATACGTTTGAGCATCTCCTTGGGGAAGATACGGAGCAGCTGC<br>CAGCCGATGTCCAGCGACTCGAATACTGTGCGGTTCTCGTAGTTGCCCTGTGTGATGA<br>AGTTCTTCTCGAACTTGGTGAGGAACTCGAGGTAGAGCAGATCGTCGGGTGTCAGGGC<br>TTCCTGACCGACGACAGCCTTCATGGCCTGCACGTCCTTACCGATGGCGTAGCAGGCG<br>TACAGCTGGTTGGAAACATCAGAGTGGTCCTTGCGGGTCATTCCCTCACCGATGGCAG<br>ACTTCATGAGACGAGACAGGGAAGGCAGCACGTTTACAGGCGGGTAGATCTGTCTGTT<br>GTGGAGCTGACGGTCTACGTAGATCTGTCCCTCAGTGATGTAGCCCGTTAAATCGGGA<br>ATAGGATGGGTGATGTCGTCGTTGGGCATAGTCAAGATGGGGATCTGCGTGATGGATC<br>CGTTTCTACCCTCTACACGCCCGGCTCTCTCGTAGATGGTGGCCAAATCGGTGTACAT<br>GTAACCTGGGAAACCACGTCGTCCGGGCACCTCCTCACGGGCGGCGGACACTTCACG<br>CAGAGCCTCCGCGTACGAAGACATGTCAGTCAAGATTACCAGCACGTGTTTCTCACAC<br>TGGTAGGCCAAGAACTCAGCAGCAGTCAAGGCCAAACGTGGTGTGATGATTCTCTCAA<br>TAGTGGGATCGTTGGCCAGATTCAAGAACAGGCACACGTTCTCCATGGAGCCGTTCTC<br>CTCGAAGTCCTGCTTGAAGAACCGGGCCGTCTCCATGTTCACACCCATGGCGGCGAAC<br>ACGATGGCAAAGTTGTCCTCGTGGTCGTCCAGCACAGATTTGCCGGGGATCTTTACAA<br>GACCGGCTTGCCTACAGATCTGGGCGGCAATTTCGTTGTGTGGCAGACCGGCAGCCG<br>AGAAAATGGGGATCTTTTGCCCGCGAGCAATGGAGTTCATCACGTCGATAGCGGAGAT<br>ACCAGTCTGGATCATTTCCTCAGGGTAGATACGGGACCAGGGGTTGATGGGCTGTCCC<br>TGGATGTCCAAAAAGTCTTCAGCAAGGATTGGGGGACCTTTGTCAATGGGTTTTCCAGA<br>GCCGTTGAATACGCGACCCAACATGTCTTCGGAGACAGGGGTGC |
| CS018 | SEQ ID NO: 1728<br>GCTCCGTCTACA<br>THCARCCNGAR<br>GG | SEQ ID NO: 1729<br>GTGCATCGGTAC<br>CAHSCHGCRTC | SEQ ID NO: 1704<br>GCTCCGTCTACATTCAGCCGGAAGGCGTCCCTGTACCTGCTCAGCAATCCCAACAGCA<br>GCAGAGTTACCGCCACGTCAGCGAGAGCGTCGAACACAAATCCTACGGCACGCAAGG<br>GTACACCACTTCGGAACAGACCAAGCAGACACAGAAGGTGGCGTACACCAACGGTTCC<br>GACTACTCTTCCACGGACGACTTTAAGGTGGATACGTTCGAATACAGACTCCTCCGAG<br>AAGTTTCGTTCAGGGAATCCATCACGAAGCGGTACATTGGCGAGACAGACATTCAGAT<br>CAGCACGGAGGTCGACAAGTCTCCGGTGTGGTGACCCCTCCTAAGATAGCACAAAAG<br>CCTAGGAATTCCAAGCTGCAGGAGGGAGCCGACGCTCAGTTTCAAGTGCAGCTGTCG |

TABLE 2-CS-continued

| Target ID | Primer Forward 5' → 3' | Primer Reverse 5' → 3' | cDNA Sequence (sense strand) 5' → 3' |
|---|---|---|---|
| | | | GGTAACCCGCGGCCACGGGTGTCATGGTTCAAGAACGGGCAGAGGATAGTCAACTCG AACAAACACGAAATCGTCACGACACATAATCAAACAATACTTAGGGTAAGAAACACACA AAAGTCTGATACTGGCAACTACACGTTGTTGGCTGAAAATCCTAACGGATGCGTCGTCA CATCGGCATACCTGGCCGTGGAGTCGCCTCAAGAAACTTACGGCCAAGATCATAAATC ACAATACATAATGGACAATCAGCAAACAGCTGTAGAAGAAAGAGTAGAAGTTAATGAAA AAGCTCTCGCTCCGCAATTCGTAAGAGTCTGCCAAGACCGCGATGTAACGGAGGGGAA AATGACGCGATTCGATTGCCGCGTCACGGGCAGACCTTACCCAGAAGTCACGTGGTTC ATTAACGATAGACAAATTCGAGACGATTATWATCATAAGATATTAGTAAACGAATCGTGT AATCATGCACTTATGATTACAAACGTCGATCTCAGTGATAGTGGCGTAGTATCATGTATA GCACGCAACAAGACCGGCGAAACTTCGTTTCAGTGTAGGCTGAACGTGATAGAAGG AGCAAGTGGTCGCTCCCAAATTCGTGGAGCGGTTCAGCACGCTCAACGTGCGCGAGG GCGAGCCCGTGCAGCTGCACGCGCGCGCCGTCGGCACGCCTACGCCACGCATCACA TGGCAGAAGGACGGCGTTCAAGTTATACCCAATCCAGAGCTACGAATAAATACCGAAG GTGGGGCCTCGACGCTGGACATCCCTCGAGCCAAGGCGTCGGACGCGGGATGGTAC CGATGCAC |

TABLE 2-PX

| Target ID | Primer Forward 5' → 3' | Primer Reverse 5' → 3' | cDNA Sequence (sense strand) 5' → 3' |
|---|---|---|---|
| PX001 | SEQ ID NO: 2110 GGCCCCAAGAAG CATTTGAAGCG | SEQ ID NO: 2111 CTTCGTGCCCTTGC CRATKATRAABACG | SEQ ID NO: 2100 GGCCCCAAGAAGCATTTGAAGCGCCTGAACGCGCCGCGCGCATGGATGCTGGA CAAGCTCGGCGTGTACGCGCCGCGCCCAGCACGGGCCCGCACAAGCTG CGCGAGTGCCTGCCGCTCGTCATCTTCCTGCAACCGCCTCAAGTACGCGCTCAG CGGCAACGAGGTGCTGAAGATCGTGAAGCAGCGCCTCATCAAGGTGGACGGCA AGGTCCGCACCGACCCCACCTACCCGGCTGGATTCATGGATGTTGTGTCGATTG AAAAGACCAATGAGCTGTTCCGTCTGATCTACGATGTGAAGGGACGCTTCACCAT CCACCGCATCACTCCCGAGGAGGCCAAGTACAAGCTGTGCAAGGTGAAGCGCG TGGCGACGGGCCCCAAGAACGTGCCGTACATCGTGACGCACAACGGCCGCACG CTGCGCTACCCCGACCCGCTCATCAAGGTCAACGACTCCATCCAGCTCGACATC GCCACCTGCAAGATCATGGACATCATCAAGTTCGACTCAGGTAACCTGTGCATGA TCACGGGAGGGCGTAACTTGGGCGAGTGGGCACCATCGTGTCCCGCGAGAGG CACCCCGGGAGCTTCGACATCGTCCACATCAAGGACACCACCGGACACACCTTC GCCACCAGGTTGAACAACGTGTTCATCATCGGCAAGGGCACGAAG |
| PX009 | SEQ ID NO: 2112 GCACGTTGATCTG GTACARRGGMAC C | SEQ ID NO: 2113 GCAGCCCACGCYYT GCACTC | SEQ ID NO: 2102 GCACGTTGATCTGGTACAAAGGAACCGGTTACGACAGCTACAAGTATTGGGAGA ACCAGCTCATTGACTTTTTGTCAGTATACAAGAAGAAGGGTCAGACAGCGGGTGC TGGTCAGAACATCTTCAACTGTGACTTCCGCAACCCGCCCCCCACACGGCAAGGT GTGCGACGTGGACATCCGCGGCTGGGAGCCCTGCATTGATGAGAACCACTTCTC TTTCCACAAGTCTTCGCCTTGCATCTTCTTGAAGCTGAATAAGATCTACGGCTGG CGTCCAGAGTTCTACAACGACACGGCTAACCTGCCTGAAGCCATGCCCGTGGAC TTGCAGACCCACATTCGTAACATTACTGCCTTCAACAGAGACTATGCGAACATGG TGTGGGTGTCGTGCCACGGCGAGACGCCGGCGGACAAGGAGAACATCGGGCC GGTGCGCTACCTGCCCTACCCGGGCTTCCCCGGGTACTTCTACCCGTACGAGAA CGCCGAGGGGTATCTGAGCCCGCTGGTCGCCGTGCATTTGGAGAGGCCGAGGA CCGGCATAGTGATCAACATCGAGTGCAAAGCGTGGGCTGC |
| PX010 | SEQ ID NO: 2114 GTGGCTGCATACA GTTCATTACGCAG | SEQ ID NO: 2115 CGCGGCTGCTCCAT GAAYASYTG | SEQ ID NO: 2104 GTGGCTGCATACAGTTCATTACGCAGTACCAGCACTCTAGTGGACAACGTCGCG TTCGGGTCACCACTGTCGCGCGCAATTGGGGCGACGCAGCCGCCAACTTACAC CACATATCGGCGGGCTTCGACCAGGAGGCGGCGGCGGTGGTGATGGCGCGGC TGGTGGTGTACCGCGCGGAGCAGGAGGACGGGCCCGACGTGCTGCGCTGGCT CGACCGCATGCTCATACGCCTGTGCCAGAAGTTCGGCGAGTACGCGAAGGACG ACCCGAACAGCTTCCGTCTGTCGGAGAACTTCAGCCTGTACCCGCAGTTCATGT ACCACCTGCGCCGCTCGCAGTTCCTGCAGGTCTTCAACAACTCGCCCGACGAGA CCACCTTCTACAGACACATGCTGATGCGCGAAGACCTGACCCAATCCCTCATCAT GATCCAGCCGATCCTCTACTCGTACAGCTTCGGAGGCGCGCCCGAACCCGTGCT GTTAGACACCAGCTCCATCCAGCCCGACCGCATCCTGCTCATGGACACCTTCTT CCAGATCCTCATCTACCATGGAGAGACAATGGCGCAATGGCGCGCTCTCCGCTA CCAAGACATGGCTGAGTACGAGAACTTCAAGCAGCTGCTGCGAGCGCCCGTGG ACGACGCGCAGGAGATCCTGCAGACCAGGTTCCCCGTGCCGCGGTACATTGATA CAGAGCACGGCGGCTCACAGGCCCGGTTCTTGCTTTCCAAAGTGAATCCCTCTC AGACTCACAACAACATGTACGCGTATGGCGGGCGATGCCGATACCATCAGCGG ACGGTGGCGCCCCGTGTTGACGGATGACGTGTCGCTGCAAGTGTTCATGGAG CAGCCGCG |
| PX015 | SEQ ID NO: 2116 GCCGCAAGGAGA CBGTVTGC | SEQ ID NO: 2117 GCAATGGCATCAAK YTCRTCRATG | SEQ ID NO: 2106 GCCGCAAGGAGACCGTGTGCATTGTGCTGTCCGACGACAACTGCCCCGACGAG AAGATCCGCATGAACCGCGTCGTCCGGAACAACCTGCGAGTGCGCCTGTCAGAC ATTGTGTCCATCGCTCCTTGCCCGTCAGTGAAGTACGGCAAGAGAGTTCATATTC TGCCCATTGATGACTCTGTTGAGGGTTTGACTGGAAACCTGTTCGAAGTCTACCT GAAGCCGTACTTCATGGAGGCGTACCGGCCCATCCACCGCGACGACACGTTCAT |

TABLE 2-PX-continued

| Target ID | Primer Forward 5' → 3' | Primer Reverse 5' → 3' | cDNA Sequence (sense strand) 5' → 3' |
|---|---|---|---|
| | | | GGTGCGCGGCGGCATGCGCGCCGTCGAGTTCAAGGTGGTGGAGACCGACCCCT CGCCCTACTGCATCGTGGCCCCCGACACGGTCATTCATTGTGAGGGAGAGCCGA TTAAACGCGAGGAAGAAGAGGAGGCTCTCAACGCCGTCGGCTACGACGACATC GGCGGGTGCCGCAAGCAGCTGGCGCAGATCAAGGAGATGGTGGAGCTGCCGCT GCGCCACCCCTCGCTGTTCAAGGCCATCGGGGTCAAGCCGCCGCGGGGGATAC TGATGTACGGGCCCCCGGGGACGGGGAAGACCTTGATCGCTAGGGCTGTCGCT AATGAGACGGGCGCATTCTTCTTCCTCATCAACGGCCCCGAGATCATGTCGAAA CTCGCCGGTGAATCCGAGTCGAACCTGCGCAAGGCGTTCGAGGAGGCGGACAA GAACTCTCCGGCCATCATCCTCATTGATGAACTTGATGCCATTGC |
| PX016 | SEQ ID NO: 2118 GTTCACCGGCGAY ATYCTGCG | SEQ ID NO: 2119 CATCTCCTTGGGGA AGATACGCAGC | SEQ ID NO: 2108 GTTCACCGGCGATATTCTGCGCACGCCCGTCTCTGAGGACATGCTGGGTCGTAT TTTCAACGGCTCCGGCAAGCCCATCGACAAGGGGCCCCCGATCCTGGCCGAGG AGTACCTGGACATCCAGGGGCAGCCCATCAACCCGTGGTCCCGTATCTACCCGG AGGAGATGATCCAGACTGGTATCTCCGCTATCGACGTGATGAACTCCATCGCCC GTGGTCAGAAGATCCCCATCTTCTCCGCCGCCGGTCTGCCCCACAACGAGATTG CTGCTCAGATCTGTAGGCAGGCTGGTCTTGTCAAGGTCCCCGGAAAATCCGTGT TGGACGACCACGAAGACAACTTCGCCATCGTGTTCGCCGCCATGGGAGTCAACA TGGAGACCGCCAGGTTCTTCAAGCAGGACTTCGAGGAGAACGGTTCCATGGAGA ACGTCTGTCTGTTCTTGAACTTGGCCAATGACCCGACCATTGAGAGGATTATCAC GCCGAGGTTGGCGCTGACTGCTGCCGAGTTCTTGGCCTACCAGTGCGAGAAACA CGTGTTGGTAATCTTGACCGACATGTCTTCATACGCGGAGGCTCTTCGTGAAGTG TCAGCCGCCCGTGAGGAGGTGCCCGGACGACGTGGTTTCCCAGGTTACATGTA CACGGATTTGGCCACAATCTACGAGCGCGCCGGGCGAGTCGAGGGCGCAACG GCTCCATCACGCAGATCCCCATCCTGACCATGCCCAACGACGACATCACCCACC CCATCCCCGACTTGACCGGGTACATCACTGAGGGACAGATCTACGTGGACCGTC AGCTGCACAACAGGCAGATCTACCCGCCGGTGAATGTGCTCCCGTCGCTATCTC GTCTCATGAAGTCCGCCATCGGAGAGGGCATGACCAGGAAGGACCACTCCGAC GTGTCCAACCAACTGTACGCGTGCTACGCCATCGGCAAGGACGTGCAGGCGAT GAAGGCGGTGGTGGGCGAGGAGGCGCTCACGCCCGACGACCTGCTCTACCTCG AGTTCCTCACCAAGTTCGAGAAGAACTTCATCACACAGGGAAGCTACGAGAACC GCACAGTGTTCGAGTCGCTGGACATCGGCTGGCAGCCCCTGCGTATCTTCCCCA AGGAGATG |

TABLE 2-AD

| Target ID | Primer Forward 5' → 3' | Primer Reverse 5' → 3' | cDNA Sequence (sense strand) 5' → 3' |
|---|---|---|---|
| AD001 | SEQ ID NO: 2374 GGCCCCAAGAAGCA TTTGAAGCG | SEQ ID NO: 2375 CGCTTGTCCCG CTCCTCNGCRA T | SEQ ID NO: 2364 GGCCCCAAGAAGCATTTGAAGCGTTTAAATGCTCCTAAAGCATGGATGTTGGACAA ACTCGGAGGAGTATTCGCTCCTCGCCCCAGTACTGGCCCCCACAAATTGCGTGAA TGTTTACCTTTGGTGATTTTTCTTCGCAATCGGCTCAAGTATGCTCTGACGAACTGT GAAGTAACGAAGATTGTTATGCAGCGACTTATCAAAGTTGACGGCAAGGTGCGAAC CGATCCGAATTATCCCGCTGGTTTCATGGATGTTGTCACCATTGAGAAGACTGGAG AGTTCTTCAGGCTGGTGTATGATGTGAAAGGCCGTTTCACAATTCACAGAATTAGT GCAGAAGAAGCCAAGTACAAGCTCTGCAAGGTCAGGAGAGTTCAAACTGGGCCAA AAGGTATTCCATTCTTGGTGACCCATGATGGCCGTACTATCCGTTATCCTGACCCA GTCATTAAAGTTAATGACTCAATCCAATTGGATATTGCCACTTGTAAAATCATGGAC CACATCAGATTTGAATCTGGCAACCTGTGTATGATTACTGGTGGACGTAACTTGGG TCGAGTGGGGACTGTTGTGAGTCGAGAACGTCACCCAGGCTCGTTTGATATTGTT CATATCAAGGATACCCAAGGACATACTTTTGCCACAAGATTGAATAATGTATTCATC ATTGGAAAAGCTACAAAGCCTTACATTTCATTGCCAAAGGGTAAGGGTGTGAAATT GAGTATCGCCGAGGAGCGGGACAAGCG |
| AD002 | SEQ ID NO: 2376 GAGTTTCTTTAGTAA AGTATTCGGTGG | SEQ ID NO: 2377 GCAATGTCATCC ATCAKRTCRTGT AC | SEQ ID NO: 2366 GAGTTTCTTTAGTAAAGTATTCGGTGGGAAGAAAGATGGAAAGGCTCCGACCACTG GTGAGGCCATTCAGAAACTCAGAGAAACAGAAGAAATGTTAATCAAAAAGCAGGAA TTTTTAGAGAAGAAAATCGAACAAGAAATCAATGTTGCAAAGAAAATGGAACGAAA AATAAGCGAGCTGCTATTCAGGCTCTGAAAAGGAAAAAGAGGTATGAAAAACAATT GCAGCAAATTGATGGCACCTTATCCACAATTGAAATGCAAAGAAGAAGCTTTGGAGG GTGCTAATACTAATACAGCTGTATTACAAACAATGAAATCAGCAGCAGATGCCCTTA AAGCAGCTCATCAGCACATGGATGTGGACAAGGTACATGACCTGATGGATGACATT GC |
| AD009 | SEQ ID NO: 2378 GAGTCCTAGCCGCV YTSGTKGC | SEQ ID NO: 2379 CTGGATTCTCTC CCTCGCAMGAH ACC | SEQ ID NO: 2368 GAGTCCTAGCCGCCTTGGTTGCAGTATGTTTATGGGTCTTCTTCCAGACACTGGAT CCTCGTATTCCCACCTGGCAGTTAGATTCTTCTATCATTGGCACATCACCTGGCCT AGGTTTCCGGCCAATGCCAGAAGATAGCAATGTAGAGTCAACTCTCATCTGGTACC GTGGAACAGATCGTGATGACTCCTCAGTGGACAGACACCCTTGATGAATTTCTT GCTGTGTACAAGACTCCTGGTCTGACCCCTGGTCGAGGTCAGAACATCCACAACT GTGACTATGATAAGCCGCCAAAGAAAGGCCAAGTTTGCAATGTGGACATCAAGAAT TGGCATCCCTGCATTCAAGAGAATCACTACAACTACCACAAGAGCTCTCCATGCAT ATTCATCAAGCTCAACAAGATCTACAATTGGATCCCTGAATACTACAATGAGAGTAC |

TABLE 2-AD-continued

| Target ID | Primer Forward 5' → 3' | Primer Reverse 5' → 3' | cDNA Sequence (sense strand) 5' → 3' |
|---|---|---|---|
| | | | GAATTTGCCTGAGCAGATGCCAGAAGACCTGAAGCAGTACATCCACAACCTGGAG AGTAACAACTCGAGGGAGATGAACACGGTGTGGGTGTCGTGCGAGGGAGAGAAT CCAG |
| AD015 | SEQ ID NO: 2380 GGATGAACTACAGC TBTTCCGHGG | SEQ ID NO: 2381 GTCCGTGGGAY TCRGCHGCAAT C | SEQ ID NO: 2370 GGATGAACTACAGCTTTTCCGAGGAGATACAGTTCTTCTTAAAGGAAAAAGGAGGA AAGAAACTGTATGCATAGTGTTATCAGATGATACATGTCCTGATGGAAAAATAAGAA TGAATAGAGTTGTACGCAACAATTTACGTGTTCGTTTGTCAGATGTTGTATCTGTAC AACCTTGTCCTGATGTTAAGTATGGAAAAAGGATACATGTACTACCAATTGATGATA CAGTTGAAGGACTAACCGGGAATTTGTTTGAGGTGTACTTAAAACCGTACTTTCTC GAAGCATACCGACCCATTCACAAAGATGATGCGTTTATTGTTCGTGGTGGTATGCG AGCAGTAGAATTCAAAGTAGTGGAAACAGATCCTTCACCATATTGTATTGTTGCTCC TGATACTGTTATTCACTGTGAAGGTGATCCAATAAAACGTGAAGAGGAAGAAGAAG CATTAAATGCTGTTGGTTATGATGACATTGGGGGTTGCCGAAAACAGCTAGCACAG ATCAAGGAAATGGTGGAATTGCCATTACGGCACCCCAGTCTCTTTAAGGCTATTGG TGTTAAGCCACCGAGGGGAATACTGCTGTATGGACCCCCTGGAACTGGTAAAACC CTCATTGCCAGGGCTGTGGCTAATGAAACTGGTGCATTCTTCTTTTTAATAAATGGT CCTGAAATTATGAGCAAGCTTGCTGGTGAATCTGAAAGCAACTTACGTAAGGCATT TGAAGAAGCTGATAAGAATGCTCCGGCAATTATATTTATTGATGAACTAGATGCAAT TGCCCCTAAAAGAGAAAAAACTCATGGAGAGGTGGAACGTCGCATAGTTTCACAAC TACTAACTTTAATGGATGGTCTGAAGCAAAGTTCACATGTTATTGTTATGGCTGCCA CAAATAGACCCAACTCTATTGATGGTGCCTTGCGCCGCTTTGGCAGATTTGATAGG GAAATTGATATTGGTATACCAGATGCCACTGGTCGCCTTGAAATTCTTCGTATCCAT ACTAAGAATATGAAGTTAGCTGATGATGTTGATTTGGAACAGATTGCAGCCGAATC CCACGGAC |
| AD016 | SEQ ID NO: 2382 GTTCACCGGCGAYA TYCTGCG | SEQ ID NO: 2383 GGAATAGGATG GGTRATRTCGT CG | SEQ ID NO: 2372 GTTCACCGGCGATATTCTGCGCGTGCCCGTGTCCGAGGACATGCTGGGCCGCAC CTTCAACGGCAGCGGCATCCCCATCGACGGCGGCCCGCCCATCGTCGCAGAGAC CTACCTCGACGTCCAGGGCATGCCGATTAATCCTCAAACGCGCATCTACCCGGAA GAAATGATCCAGACGGGGATCTCGACCATCGACGTGATGACGTCCATCGCGCGAG GGCAGAAGATCCCCATCTTCTCGGGCGCAGGGCTGCCACACAACGAGATCGCTG CGCAGATCTGCCGACAGGCGGGCTGGTGCAGCACAAGGAGAACAAGGACGACT TCGCCATCGTGTTCGCGGCGATGGCGTCAACATGGAGACGGCGCGCTTCTTCAA GCGCGAGTTCGCGCAGACGGGCGCGTGCAACGTGGTGCTGTTCCTCAACCTGGC CAACGACCCCACCATCGAGCGCATCATCACCCCGCGCCTCGCGCTCACCGTGGC CGAGTTCCTGGCCTACCAGTGCAACAAGCACGTGCTCGTCATCATGACCGACATG ACCTCCTACGCGGAGGCGCTGCGCGAGGTGAGCGCGGCGCGCGAGGAGGTTCC TGGGCGAAGAGGCTTCCCAGGCTACATGTACACCGATCTCTCCACCATCTACGAG CGCGCTGGCCGTGTGCAAGGCCGCCCCGGCTCCATCACTCAGATCCCCATCCTG ACGATGCCCAACGACGACATCACCCATCCTATTC |

TABLE 3-LD

| Target ID | cDNA SEQ ID NO | Corresponding amino acid sequence of cDNA clone |
|---|---|---|
| LD001 | 1 | SEQ ID NO: 2 (frame + 1) GPKKHLKRLNAPKAWMLDKLGGVFAPRPSTGPHKLRESLPLVIFLRNRLKYALTNSEVTKIVMQRLIKVDGKVRTD SNYPAGFMDVITIEKTGEFFRLIYDVKGRFAVHRITAEEAKYKLCKVRRMQTGPKGIPFIVTHDGRTIR |
| LD002 | 3 | SEQ ID NO: 4 (frame - 3) AMQALKRKKRLEKNQLQIDGTLTTIELQREALEGASTNTTVLESMKNAAEALKKAHKNLDVDNVHDMMDDI |
| LD003 | 5 | SEQ ID NO: 6 (frame - 2) PRRPYEKARLDQELKIIGEYGLRNKREVWRVKYTLAKIRKAARELLTLEEKDQRRLFEGNALLRRLVRIGVLDETRM KLDYVLGLKIEDFLERRLQTQVFKLGLAKSIHHARVLVRQRHIRVRKQVVNIPSFIVRLDSQKHIDFSLKSPFGGGRP GRVKRKNL |
| LD006 | 7 | SEQ ID NO: 8 (frame + 1) HNYGWQVLVASGVVEYIDTLEEETVMIAMNPEDLRQDKEYAYCTTYTHCEIHPAMILGVCASIIPFPDHNQSPRNT YQSAMGKQAMGVYITNFHVRMDTLAHVLYYPHKPLVTTRSMEYLRFRELPAGINSIVAIACYTGYNQEDSVILNAS AVERGFFRSVFYRSYKDAESKRIGDQEEQFE |
| LD007 | 9 | SEQ ID NO: 10 (frame + 1) PKKDVKGTYVSIHSSGFRDFLLKPEILRAIVDCGFEHPSEVQHECIPQAVIGMDILCQAKSGMGKTAVFVLATLQQL EPADNVVYVLVMCHTRELAFQISKEYERFSKYMPSVKVGVFFGGMPIANDEEVLKNKCPHIVVGTPGRILALVKSR KLVLKNLKHFILDECDKMLELLDMRRDVQEIYRNTPHTKQVMMFSATLSKEIRPVCKKFMQDPMEVYVDDEAKLTL HGLQQHYVKLKENEKNKKLFELLDVLEFNQVVIFVKSVQRCVALAQLLTEQNFPAIGIHRGMDQKERLSRYEQFKD FQKRILVATNLFGRGMDIERVNIVFNYDMPEDSDTYLH |
| LD010 | 11 | SEQ ID NO: 12 (frame + 1) VKCSRELKIQGGIGSCVSLNVKNPLVSDTEIGMGNTVQWKMCTVTPSTTMALFFEVVNQHSAPIPQGGRGCIQFIT QYQHASGQKRIRVTTVARNWADASANIHHVSAGFDQEAAAVIMARMAVYRAESDDSPDVLRWVDRMLIRLCQKF |

TABLE 3-LD-continued

| Target cDNA ID | SEQ ID NO | Corresponding amino acid sequence of cDNA clone |
|---|---|---|
| | | GEYNKDDPNSFRLGENFSLYPQFMYHLRRSQFLQVFNNSPDETSFYRHMLMREDLTQSLIMIQPILYSYSFNGPP EPVLLDTSSIQPDRILLMDTFFQILIFHGETIAQW |
| LD011 | 13 | SEQ ID NO: 14 (frame - 1)<br>PTFKCVLVGDGGTGKTTFVKRHMTGEFEKRYVATLGVEVHPLVFHTNRGPIRFNVWDTAGQEKFGGLRDGYYIQ GQCAIIMFDVTSRVTYKNVPNWHRDLVRVCENIPIVLCGNKVDIKDRKVKAKSIVFHRKKNLQYYDISAKSNYNFEK PFLWLARKLIGDPNLEFVAMPALLP |
| LD014 | 15 | SEQ ID NO: 16 (frame + 3)<br>QIKHMMAFIEQEANEKAEEIDAKAEEEFNIEKGRLVQQQRLKIMEYYEKKEKQVELQKKIQSSNMLNQARLKVLKV REDHVRTVLEEARKRLGQVTNDQGKYSQILESLILQGLYQLFEKDVTIRVRPQDRELVKSIIPTVTNKYKDATGKDI HLKIDDEIHLSQETTGGIDLLAQKNKIKISNTMEARLELISQQLLPEI |
| LD015 | 17 | SEQ ID NO: 18 (frame - 1)<br>RHPSLFKAIGVKPPRGILLYGPPGTGKTLIARAVANETGAFFFLINGPEIMSKLAGESESNLRKAFEEADKNSPAIIFI DELDAI |
| LD016 | 19 | SEQ ID NO: 20 (frame - 2)<br>TVSGVNGPLVILEDVKFPKYNEIVQLKLADGTIRSGQVLEVSGSKAVVQVFEGTSGIDAKNTACEFTGDILRTPVSE DMLGRVFNGSGKPIDKGPPILAEDFLDIQGQPINPWSRIYPEEMIQTGITAIDVMNSIARGQKIPIFSAAGLPHNEIAA QICRQAGLVKIPGKSVLDDHEDNFAIVFAAMGVNMETARFFKQDFEENGSMENVCLFLNLANDPTIERIITPRLALT AAEFLAYQCEKHVLVILTDMSSYAEALREVSAAREEVPGRRGFPGYMYTDLATIYERAGRVEGRNGSITQIPILTMP NDDITHPI |
| LD018 | 21 | SEQ ID NO: 22 (frame + 2)<br>TWFKDGQRITESQKYESTFSNNQASLRVKQAQSEDSGHYTLLAENPQGCIVSSAYLAIEPVTTQEGLIHESTFKQQ QTEMEQIDTSKTLAPNFVRVCGDRDVTEGKMTRFDCRVTGRPYPDVTWYINGRQVTDDHNHKILVNESGNHALM ITTVSRNDSGVVTCVARNKTGETSFQCNLNVIEKEQVVAPKFVERFTTVNVAEGEPVSLRARAVGTPVPRITWQR DGAPLASGPDVRIAIDGGASTLNISRAKASDAAWYRC |
| LD027 | 23 | SEQ ID NO: 24 (frame + 1)<br>HGGDKPYLISGADDRLVKIWDYQNKTCVQTLEGHAQNVTAVCFHPELPVALTGSEDGTVRVWHTNTHRLENCLN YGFERVWTICCLKGSNNVSLGYDEGSILVKVGREEPAVSMDASGGKIIWARHSELQQANLKALPEGGEIRDGERL PVSVKDMGACEIYPQTIQHNPNGRFVVVCGDGEYIIYTAMALRNKAFGSAQEFVWAQDSSEYAIRESGSTIRIFKN FKERKNPFKSDFSAEGIYGGFLLGIKSVSGLTFYDWETLDLVRRIEIQPRAVYWSDSGKLVCLATEDSYFILSYDSEQ VQKARENNQVAEDGVEAAFDVLGEMNESVRTGLWVGDCFIYT |

TABLE 3-PC

| Target cDNA ID | SEQ ID NO | Corresponding amino acid sequence of cDNA clone |
|---|---|---|
| PC001 | 247 | SEQ ID NO: 248 (frame + 1)<br>AWMLDKLGGVFAPRPSTGPHKLRESLPLVIFLRNRLKYALTNSEVTKIVMQRLIKVDGKVRTDSNYPAGFMDVITIE KTGEFFRLIYDVKGRFAVHRITAEEEAKYKLCKVRRVQTGPKGIPFLVTHDGRTIRYPDPNIKVNDTIQMEIATSKILDY IKFES |
| PC003 | 249 | SEQ ID NO: 250 (frame: + 2)<br>PRRPYEKARLDQELKIIGAFGLRNKREVWRVKYTLAKIRKAARELLTLEEKEPKRLFEGNALLRRLVRIGVLDENRM KLDYVLGLKIEDFLERRLQTQVFKSGLAKSIHHARVLIRQRHIRVRKQVVNIPSFIVRLDSQKHIDFSLKSPFGGGRP GRV |
| PC005 | 251 | SEQ ID NO: 252 (frame + 3)<br>PNEINEIANTNSRQNIRKLIKDGLIIKKPVAVHSRARVRKNTEARRKGRHCGFGKRKGTANARMPQKELWVQRMR VLRRLLKKYREAKKIDRHLYHALYMKAKGNVFRNKRVLMEYIHKKKAEKARAKMLSDQANARRLKVKQARERRE |
| PC010 | 253 | SEQ ID NO: 254 (frame + 3)<br>LKDSLQMSLSLLPPNALIGLITFGKMVQHELGTEGCSKSYVFCGTKDLTAKQVQEMLGIGKGSPNPQQQPGQPG RPGQNPQAAPVPPGSRFLQPVSKCDMNLTDLIGELQKDPWPVHQGKRPLRSTGAALSIAVGLLECTYPNTGGRI MIFLGGPCSQGPGQVLNDDLKQPIRSHHDIHKDNAKYMKKAIKHYDHLAMRAATNSHCIDIYSCALDQTGLMEMK QCCNSTGGHMVMGDSFNSSLFKQTFQRVFSKDPKNDLKMAFNATLEVKCSRELKVQGGIGSCVSLNVKSPLVSD TELGMGNTVQWKLCTLAPSSTVALFFEVVNQHSAPIPQGGRGCIQLITQYQHASGQRRIRVTTIARNWADATANIH HISAGFDQEAAAVVMARMAGYKAESDETPDVLRWVDRMLIRLCQKFGEYNKDDPNSFRLGENFSLYPQFMYHLR RSQFLQVFNNSPDETSFYRHMLMREDLTQSLIMIQPILYSYSFNGPPEPVLLDTSSIQPDRILLMDTFFQILIFHGETI AQW |
| PC014 | 255 | SEQ ID NO: 256 (frame + 3)<br>DVQKQIKHMMAFIEQEANEKAEEIDAKAEEEFNIEKGRLVQQQRLKIMEYYEKKEKQVELQKKIQSSNMLNQARLK VLKVREDHVRAVLEDARKSLGEVTKDQGKYSQILESLILQGLFQLFEKEVTVRVRPQDRDLVRSILPNVAAKYKDA TGKDILLKVDDESHLSQEITGGVDLLAQKNKIKISNTMEARLDLIA |
| PC016 | 257 | SEQ ID NO: 258 (frame + 2)<br>LVILEDVKFPKFNEIVQLKLADGTLRSGQVLEVSGSKAVVQVFEGTSGIDAKNTVCEFTGDILRTPVSEDMLGRVFN GSGKPIDKGPPILAEDYLDIQGQPINPWSRIYPEEMIQTGITAIDVMNSIARGQKIPIFSAAGLPHNEIAAQICRQAGL |

TABLE 3-PC-continued

| Target ID | cDNA SEQ ID NO | Corresponding amino acid sequence of cDNA clone |
|---|---|---|
| | | VKVPGKSVLDDHEDNFAIVFAAMGVNMETARFFKQDFEENGSMENVCLFLNLANDPTIERIITPRLALTAAEFLAYQ CEKHVLVILTDMSSYAEALREVSAAREEVPGRRGFPGYMYTDLATIYERAGRVEGRNGSITQIPILTMP |
| PC027 | 259 | SEQ ID NO: 260 (frame + 1)<br>QANLKVLPEGAEIRDGERLPVTVKDMGACEIYPQTIQHNPNGRFVVVCGDGEYIIYTAMALRNKAFGSAQEFVWA QDSSEYAIRESGSTIRIFKNFKEKKNFKSDFGAEGIYGGFLLGVKSVSGLAFYDWETLELVRRIEIQPRAIYWSDSG KLVCLATEDSYFILSYDSDQVQKARDNNQVAEDGVEAAFDVLGEINESVRTGLWVGDCFIYTNAVNRINYFVGGEL VTIAHLDRPLYVLGYVPRDDRLYLVDKELGVVSYXIAIICTRISDCSHATRLPNG*SSIAFNSK |

TABLE 3-EV

| Target ID | cDNA SEQ ID NO | Corresponding amino acid sequence of cDNA clone |
|---|---|---|
| EV005 | 513 | SEQ ID NO: 514 (frame + 3)<br>RCGKKKVWLDPNEITEIANTNSRQNIRKLIKDGLIIKKPVAVHSRARVRKNTEARRKGRHCGFGKRKGTANARMPRK ELWIQRMRVLRRLLKKYREAKKIDRHLYHALYMKAKGNVFKNKRVMMDYIHKKKAEKARTKMLNDQADARRLKVKE ARKRREERIATKKQ |
| EV009 | 515 | SEQ ID NO: 516 (frame + 1)<br>PTLDPSIPKYRTEESIIGTNPGMGFRPMPDNNEESTLIWLQGSNKTNYEKWKMNLLSYLDKYYTPGKIEKGNIPVKRC SYGEKLIRGQVCDVDVRKWEPCTPENHFDYLRNAPCIFLKLNRIYGWEPEYYNDPNDLPDDMPQQLKDHIRYNITNP VERNTVWVTCAGENPADVEYLGPVKYYPSFQGFPGYYFPYLNSEGYLSPLLAVQFKRPVSGIVINIECKAWA |
| EV010 | 517 | SEQ ID NO: 518 (frame + 3)<br>GGHMVMGDSFNSSLFKQTFQRVFSKDSNGDLKMSFNAILEVKCSRELKVQGGIGPCVSLNVKNPLVSDLEIGMGNT VQWKLCSLSPSTTVALFFEVVNQHAAPIPQGGRGCIQFITQYQHSSGQKKIRVTTIARNWADATANIHHISAGFDEQT AAVLMARIAVYRAETDESSDVLRWVDRMLIRLCQKFGEYNKDDTNSFRLSENFSLYPQFMYHLRRSQFLQVFNNSP DETSFYRHMLMREDRNQ |
| EV015 | 519 | SEQ ID NO: 520 (frame + 1)<br>RHPSLFKAIGVKPPRGILLYGPPGTGKTLIARAVANETGAFFFLINGPEIMSKLAGESESNLRKAFEEADKNSPAIIFIDE LDAIAPKREKTHGEVERRIVSQLLTLMDGMKKSSHVIVMAATNRPNSIDPALRRFGRFDREIDIGIPDATGRLEVLRIHT KNMKLADDVDLEQIAAETHGHVGADLASLCSEAALQQIREKMDLIDLDDEQIDAEVLNSLAVTMENFRYAMSKSSPSA LRETV |
| EV016 | 521 | SEQ ID NO: 522 (frame + 2)<br>TVSGVNGPLVILDSVKFPKFNEIVQLKLSDGTVRSGQVLEVSGQKAVVQVFEGTSGIDAKNTLCEFTGDILRTPVSED MLGRVFNGSGKPIDKGPPILAEDFLDIQGQPINPWSRIYPEEMIQTGISAIDVMNSIARGQKIPIFSAAGLPHNEIAAQIC RQAGLVKIPGKSVLDDHEDNFAIVFAAMGVNMETARFFKQDFEENGSMENVCLFLNLANDPTIERIITPRLTLTAAEFM AYQCEKHVLVILTDMSSYAEALREVSAA |

TABLE 3-AG

| Target ID | cDNA SEQ ID NO | Corresponding amino acid sequence of cDNA clone |
|---|---|---|
| AG001 | 601 | SEQ ID NO: 602 (frame + 1)<br>HLKRFAAPKAWMLDKLGGVFAPRPSTGPHKLRESLPLVIFLRNRLKYALTNCEVTKIVMQRLIKVDGKVRTDPNYPAG FMDVITIEKTGEFFRLIYDVKGRFTIHRITAEEEAKYKLCKVRKVQTGPKGIPFLVTHDGRTIRYPDPMIKVNDTIQLEIATS KILDFIKFESGNLCMITGGRNLGRVGTVVNRERHPGSFDIVHIRDANDHVFATRLNNVFVIGKGSKAFVSLPRGKGVK LSIA |
| AG005 | 603 | SEQ ID NO: 604 (frame + 2)<br>VWLDPNEINEIANTNSRQNIRKLIKDGLIIKKPVAVHSRARVRKNTEARRKGRHCGFGKRKGTANARMPQKELWIQR MRVLRRLLKKYREAKKIDRHLYHALYMKAKGNVFKNKRVLMEYIHKKKAEKARAKMLDQANARRQKVKQVP*EEG RAYRREEAG |
| AG010 | 605 | SEQ ID NO: 606 (frame + 3)<br>GGHMLMGDSFNSSLFKQTFQRVFAKDQNGHLKMAFNGTLEVKCSRELKVQGGIGSCVSLNVKSPLVADTEIGMGN TVQWKMCTFNPSTTMALFFEVVNQHSAPIPQGGRGCIQFITQYQHSSGQRRIRVTTIARNWADASANIHHISAGFDQ ERAAVIMARMAVYRAETDESPDVLRWVDRMLIRLCQKFGEYNKDDQASFRLGENFSLYPQFMYHLRRSQFLQVFNN SPDETSFYRHMLMREDLTQSLIMIQPILYSYSFNGPPEPVLLDTSSIQPDRILLMDTFFQILIFHGETIAQW |
| AG014 | 607 | SEQ ID NO: 608 (frame + 3)<br>QIKHMMAFIEQEANEKAEEIDAKAEEEFNIEKGRLVQQQRLKIMEYYEKKEKQVELQKKIQSSNMLNQARLKVLKVRE DHVRAVLDEARKKLGEVTRDQGKYAQILESLILQGLYQLFEANVTVRVRPQDRTLVQSVLPTIATKYRDVTGRDVHLS IDDETQLSESVTGGIELLCKQNKIKVCNTLEARLDLISQQLVPQIRNALFGRNINRKF |

TABLE 3-AG-continued

| Target ID | cDNA SEQ ID NO | Corresponding amino acid sequence of cDNA clone |
|---|---|---|
| AG016 | 609 | SEQ ID NO: 610 (frame + 1)<br>VSEDMLGRVFNGSGKPIDKGPPILAEDFLDIQGQPINPWSRIYPEEMIQTGISAIDVMNSIARGQKIPIFSAAGLPHNEIA<br>AQICRQAGLVKLPGKSVIDDHEDNFAIVFAAMGVNMETARFFKQDFEENGSMENVCLFLNLANDPTIERIITPRLALTA<br>AEFLAYQCEKHVLVILTDMSSYAEALREVSAAREEVPGRRGFPGYMYTDLATIYERAGRVEGRNGSITQIPILTMPND<br>DITHPI |

TABLE 3-TC

| Target ID | cDNA SEQ ID NO | Corresponding amino acid sequence of cDNA clone |
|---|---|---|
| TC001 | 793 | SEQ ID NO: 794 (frame + 1)<br>GPKKHLKRLNAPKAWMLDKLGGVFAPRPSTGPHKLRESLPLVIFLRNRLKYALTNSEVTKIVMQRLIKVDGKVRTD<br>PNYPAGFMDVVTIEKTGEFFRLIYDVKGRFTIHRITGEEEAKYKLCKVKKVQTGPKGIPFLVTRDGRTIRYPDPMIKVN<br>DTIQLEIATSKILDFIKFESGNLCMITGGRNLGRVGTVVSRERHPGSFDIVHIKDANGHTFATRLNNVFIIGKGSKPYV<br>SLPRGKGVKLSI |
| TC002 | 795 | SEQ ID NO: 796 (frame + 1)<br>QEFLEAKIDQEILTAKKNASKNKRAAIQAIKRKKRYEKQLQQIDGTLSTIEMQREALEGANTNTAVLKTMKNAADAL<br>KNAHLNMDVDEVHDMMDDI |
| TC010 | 797 | SEQ ID NO: 798 (frame + 3)<br>PEVLVFGHVLVLEVPPLGDCLTVENQNLEKCVHEKDPIGLNGTSVEEDGFRGAVETITVQNRLDHNETLGEVLPH<br>QHVAVERGLVWGVVENLEELGAAQMVHELGIETEVFTQTETVRVVFVVFAEF |
| TC014 | 799 | SEQ ID NO: 800 (frame + 1)<br>EKAEEIDAKAEEEFNIEKGRLVQQQRLKIMEYYEKKEKPVELQKKIQSSNMLNQARLKVLKVREDHVHNVLDDARK<br>RLGEITNDQARYSQLLESLILQSLYQYLGISDELFENNIVVRVRQQDRSIIQGILPVVATKYRDATGKDVHLKIDDES<br>HLPSETTGGVVLYAQKGKIKIDNTLEARLDLIAQQLVPEIRTALFGRNINRKF |
| TC015 | 801 | SEQ ID NO: 802 (frame + 2)<br>DELQLFRGDTVLLKGKRRKETVCIVLADENCPDEKIRMNRIVRNNLRVRLSDVVWIQPCPDVKYGKRIHVLPIDDTV<br>EGLVGNLFEVYLKPYFLEAYRPIHKGDVFIVRGGMRAVEFKVVETEPSPYCIVAPDTVIHCDGDPIKREEEEEALNA<br>VGYDDIGGCRKQLAQIKEMVELPLRHPSLFKAIGVKPPRGILLYGPPGTGKTLIARAVANETGAFFFLINGPEIMSKL<br>AGESESNLRKAFEEADKNSPAIIFIDELDAIAPKREKTHGEVERRIVSQLLTLMDGMKKSSHVIVMAATNRPNSIDPA<br>LRRFGRFD |

TABLE 3-MP

| Target ID | cDNA SEQ ID NO | Corresponding amino acid sequence of cDNA clone |
|---|---|---|
| MP001 | 888 | SEQ ID NO: 889 (frame + 1)<br>GPKKHLKRLNAPKAWMLDKSGGVFAPRPSTGPHKLRESLPLLIFLRNRLKYALTGAEVTKIVMQRLIKVDGKVRTDPN<br>YPAGFMDVISIQKTSEHFRLIYDVKGRFTIHRITPEEAKYKLCKVKRVQTGPKGVPFLTTHDGRTIRYPDPNIKVNDTIR<br>YDIASSKILDHIRFETGNLCMITGGRNLGRVGIVTNRERHPGSFDIVHIKDANEHIFATRMNNVFIIGKGQKNYISLPRSK<br>GVKLT |
| MP002 | 890 | SEQ ID NO: 891 (frame + 2)<br>SFFSKVFGGKKEEKGPSTEDAIQKLRSTEEMLIKKQEFLEKKIEQEVAIAKKNGTTNKRAALQALKRKKRYEQQLAQID<br>GTMLTIEQQREALEGANTNTAVLTTMKTAADALKSAHQNMNVDDVHDLMDDI |
| MP010 | 892 | SEQ ID NO: 893 (frame + 3)<br>GCIQFITQYQHSSGYKRIRVTTLARNWADPVQNMMHVSAAFDQEASAVLMARMVVNRAETEDSPDVMRWADRTLI<br>RLCQKFGDYQKDDPNSFRLPENFSLYPQFMYHLRRSQFLQVFNNSPDETSYYRHMLREDVTQSLIMIQPILYSYSF<br>NGRPEPVLLDTSSIQPDKILLMDTFFHILIFHGETIAQWRAMDYQNRPEYSNLKQLLQAPVDDAQEILKTRFPMPRYID<br>TEQGGSQARFLLCKVNPSQTHNNMYAYGG*WWSTSFDR*CKLAAVHGAAA |
| MP016 | 894 | SEQ ID NO: 895 (frame + 1)<br>VSEDMLGRVFNGSGKPIDKGPPILAEDYLDIEGQPINPYSRTYPQEMIQTGISAIDIMNSIARGQKIPIFSAAGLPHNEIA<br>AQICRQAGLVKKPGKSVLDDHEDNFAIVFAAMGVNMETARFFKQDFEENGSMENVCLFLNLANDPTIERIITPRLALT<br>AAEFLAYQCEKHVLVILTDMSSYAEALREVSAAREEVPGRRGFPGYMYTDLATIYERAGRVEGRNGSITQIPILTMPN<br>DDITHPI |
| MP027 | 896 | SEQ ID NO: 897 (frame + 3)<br>PITKTRRVFRH*KAMLKIFLLVCFHPELPIVLTGSEDGTVRIWHSGTYRLESSLNYGLERVWTICCLRGSNNVALGYDE<br>GSIMVKVGREEPAMSMDVHGGKIVWARHSEIQQANLKAMLQAEGAEIKDGERLPIQVKDMGSCEIYPQSISHNPNG<br>RFLVVCGDGEYIIYTSMALRNKAFGSAQDFVWSSDSEYAIRENSSTIKVFKNFKEKKSFKPEGGADGIFGGYLLGVKS<br>VTGLALYDWENGNLVRRIETQPKHVFWSESGELVCLATDEAYFILRFDVNVLSAARASNYEAASPDGLEDAFEILGEV<br>QEVVKTGLWVGDCFIYTNGVNRINYYVGGEVVTVS |

TABLE 3-NL

| Target ID | cDNA SEQ ID NO | Corresponding amino acid sequence of cDNA clone |
|---|---|---|
| NL001 | 1071 | SEQ ID NO: 1072 (frame + 2)<br>KSWMLDKLGGVYAPRPSTGPHKLRESLPLVIFLRNRLKYALTNCEVKKIVMQRLIKVDGKVRTDPNYPAGFMDVVQIEK<br>TNEFFRLIYDVKGRFTIHRITAEEAKYKLCKVKRVQTGPKGIPFLTTHDGRTIRYPDPLVKVNDTIQLDIATSKIMDFIRFDS<br>GNLCMITGGRNLGRVGTVVNRERHPGSFDIVHIKDVLGHTFATRLNNVFIIGKGSKAYVSLPKGKGVKLS |
| NL002 | 1073 | SEQ ID NO: 1074 (frame + 1)<br>DEKGPTTGEAIQKLRETEEMLIKKQDFLEKKIEVEIGVARKNGTKNKRAAIQALKRKKRYEKQLQQIDGTLSTIEMQREAL<br>EGANTNTAVLQTMKNAADALKAAHQHMDVDQ |
| NL003 | 1075 | SEQ ID NO: 1076 (frame + 2)<br>PRRPYEKARLEQELKIIGEYGLRNKREVWRVKYALAKIRKAARELLTLEEKDQKRLFEGNALLRRLVRIGVLDEGRMKLD<br>YVLGLKIEDFLERRLQTQVYKLGLAKSIHHARVLIRQRHI RVRKQVVNIPSFVVRLDSQKHIDFSLKSPFGGGRPGRV |
| NL004 | 1077 | SEQ ID NO: 1078 (frame + 1)<br>KELAAVRTVCSHIENMLKGVTKGFLYKMRAVYAHFPINCVTTENNSVIEVRNFLGEKYIRRVRMAPGVTVTNSTKQKDEL<br>IVEGNSIEDVSRSAALIQQSTTVKNKDIRKFLD |
| NL005 | 1079 | SEQ ID NO: 1080 (frame + 1)<br>LDPNEINEIANTNSRQSIRKLIKDGLIIKKPVAVHSRARVRKNTEARRKGRHCGFGKRKGTANARMPQKVLWVNRMRVL<br>RRLLKKYRQDKKIDRHLYHHLYMKAKGNVFKNKRVLMEFIHKKKAEKARMKMLNDQAEARRQKVKEAKKRRE |
| NL006 | 1081 | SEQ ID NO: 1082 (frame + 3)<br>VLVSSGVVEYIDTLEEETTMIAMSPDDLRQDKEYAYCTTYTHCEIHPAMILGVCASIIPFPDHNQSPRNTYQSAMGKQAM<br>GVYITNPHVRMDTLAHVLFYPHKPLVTTRSMEYLRFRELPAGINSVVAIACYTGYNQEDSVILNASAVERGFFRSVFFRS<br>YKDAESKRIGDQEEQFEKPTRQTCQGMRNAIYDKLDDDGIIAPGLRVSGDDVVIGKTITLPDNDDELEGTTKRFTKRDAS<br>TFLRNSETGIVDQVMLTLNSEGYKFCKIRVRSVRIPQIGDKFASRHGQKGTCGIQYRQEDMPFTSEGIAPDIIINPHAIPSR<br>MTIGHLIECLQGKVSSNKGEIGDATPFN |
| NL007 | 1083 | SEQ ID NO: 1084 (frame + 2)<br>FRDFLLKPEILRAILDCGFEHPSEVQHECIPQAVLGMDILCQAKSGMGKTAVFVLATLQQ1EPTDNQVSVLVMCHTRELA<br>FQISKEYERFSKCMPNIKVGVFFGGLPIQRDEETLKLNCPHIVVGTPGRILALVRNKKLDLKHLKHFVLDECDKMLELLDM<br>RRDVQEIFRNTPHSKQVMMFSATLSKEIRPVCKKFMQDPMEVYVDDEAKLTHGLQQHYVKLKENEKNKKLFELLDILE<br>FNQVVIFVKSVQRCMALSQLLTEQNFPAVAIHRGMTQEERLKKYQEFKEFLKRILVATNLFGRGMDIERVNIVFNYDMP |
| NL008 | 1085 | SEQ ID NO: 1086 (frame + 1)<br>GRIENQKRVVGVLLGCWRPGGVLDVSNSFAVPFDEDDKEKNVWFLDHDYLENMFGMFKKVNAREKVVGWYHTGPKL<br>HQNDVAINELIRRYCPNCVLVIIDAKPKDLGLPTEAYRVVEEIHDDGSPTSKTFEHVMSEIGAEEEAEEIGVEHLLRDIKDTT<br>VGSLSQRVTNQLMGLKGLHLQLQDMRDYLNQVVEGKLPMNHQIVYQLQDIFNLLPDIGHGNFVDSLY |
| NL009 | 1087 | SEQ ID NO: 1088 (frame + 1)<br>CDYDRPPGRGQVCDVDVKNWFPCTSENNFNYHQSSPCVFLKLNKIIGWQPEYYNETEGFPDNMPGDLKRHIAQQKSI<br>NKLFMQTIWITCEGEGPLDKENAGEIQYIPRQGFPGYFYPYTNA |
| NL010 | 1089 | SEQ ID NO: 1090 (amino terminus end) (frame + 2)<br>SSRLEATRLVVPVGCLYQPLKERPDLPPVQYDPVLCTRNTCRAILNPLCQVDYRAKLWVCNFCFQRNPFPPQYAAISEQ<br>HQPAELIPSFSTIEYIITRAQTMPPMFVLVVDTCLDDEELGALKDSLQMSLSLLPPNALIGLITFGKMVQVHELGCDGCSK<br>SYVFRGVKDLTAKQIQDMLGIGKMAAAPQPMQQRIPGAAPSAPVNRFLQPVGKCDMSLTDLLGELQRDPWNVAQGKR<br>PLR STGVALSIAVGLLECT |
| | 1115 | SEQ ID NO: 1116 (carboxy terminus end) (frame + 3)<br>LNVKGSCVSDTDIGLGGTSQWKMCAFTPHTTCAFFFEVVNQHAAPIPQGGRGCIQFITQYQHSSGQRRIRVTTIARNWA<br>DASTNLAHISAGFDQEAGAVLMARMVVHRAETDDGPDVMRWADRMLIRLCQRFGEYSKDDPNSFRLPENFTLYPQFM<br>YHLRRSQFLQVFNNSPDETSYYRHILMREDLTQSLIMIQPILYSYSFNGPPEPVLLDTSSIQPDRILLMDTFFQILIFHGETI<br>A |
| NL011 | 1091 | SEQ ID NO: 1092 (frame + 2)<br>DGGTGKTTFVKRHLTGEFEKKYVATLGVEVHPLVFHTNRGVIRFNVWDTAGQEKFGGLRDGYYIQGQCAIIMFDVTSRV<br>TYKNVPNWHRDLVRVCENIPIVLCGNKVDIKDRKVKAKSIVFHRKKNLQYYDISAKSNYNFEKPFLWLAKKLIGDPNLEFV<br>AMPALLPPEVTMDPQX |
| NL012 | 1093 | SEQ ID NO: 1094 (frame + 2)<br>QQTQAQVDEVVDIMKTNVEKVLERDQKLSELDDRADALQQGASQFEQQAGKLKRKF |
| NL013 | 1095 | SEQ ID NO: 1096 (frame + 2)<br>AEQVYISSLALLKMLKHGRAGVPMEVMGLMLGEFVDDYTVRVIDVFAMPQSGTGVSVEAVDPVFQAKMLDMLKQTGR<br>PEMVVGWYHSHPGFGCWLSGVDINTQESFEQLSKRAVAVVV |
| NL014 | 1097 | SEQ ID NO: 1098 (frame + 2)<br>FIEQEANEKAEEIDAKAEEEFNIEKGRLVQHQRLKIMEYYDRKEKQVELQKKIQSSNMLNQARLKALKVREDHVRSVLEE<br>SRKRLGEVTRNPAKYKEVLQYLIVQGLLQLLESNVVLRVR<br>EADVSLIEGIVGSCAEQYAKMTGKEVVVKLDADNFLAAETCGGVELFARNGRIKIPNTLESRLDLISQQLVPEIRVALF |
| NL015 | 1099 | SEQ ID NO: 1100 (frame + 1)<br>IVLSDETCPFEKIRMNRVVRKNLRVRLSDIVSIQPCPDVKYGKRIHVLPIDDTVEGLTGNLFEVYLKPYFLEAYRPIHKDDA<br>FIVRGGMRAVEFKVVETDPSPYCIVAPDTVIHCEGDPIKREDEEDAANAVGYDDIGGCRKQLAQIKEMVELPLRHPSLFK |

TABLE 3-NL-continued

| Target ID | cDNA SEQ ID NO | Corresponding amino acid sequence of cDNA clone |
|---|---|---|
| | | AIGVKPPRGILLYGPPGTGKTLIARAVANETGAFFFLINGPEIMSKLAGESESNLRKAFEEADKNAPAIIFIDELDAIAPKRE KTHGEVERRIVSQLLTLMDGLKQSSHVIVMAATNRPNSIDAALRRFGRFDREIDIGIPDATGRLEVLRIHTKNMKLADDVD LEX |
| NL016 | 1101 | SEQ ID NO: 1102 (frame + 2) TPVSEDMLGRVFNGSGKPIDKGPPILAEDYLDIQGQPINPWSRIYPEEMIQTGISAIDVMNSIARGQKIPIFSAAGLPHNEIA AQICRQAGLVKLPGKSVLDDSEDNFAIVFAAMGVNMETARFFKQDFEENGSMENVCLFLNLANDPTIERIITPRLALTAAE FLAYQCEKHVLILTDMSSYAEALREVSAAREEVPGRRGFPGYMYTDLATIYERAGRVEGRNGSIT |
| NL018 | 1103 | SEQ ID NO: 1104 (frame + 2) MQMPVPRPQIESTQQFIRSEKTTYSNGFTTIEEDFKVDTFEYRLLREVSFRESLIRNYLHEADMQMSTVVDRALGPPSAP HIQQKPRNSKIQEGGDAVFSIKLSANPKPRLVWFKNGQRIGQTQKHQASYSNQTATLKVNKVSAQDSGHYTLLAENPQ GCTVSSAYLAVESAGTQDTGYSEQYSRQEVETTEAVDSSKMLAPNFVRVPADRDASEGKMTRFDCRVTGRPYPDVA WFINGQQVADDATHKILVNESGNHSLMITGVTRLDHGVVGCIARNKAGETSFQCNLNVIEKELVVAPKFVERFAQVNVK EGEPVVLSARAVGTPVPRITWQKDGAPIQSGPSVSLFVDGGATSLDIPYAKAS |
| NL019 | 1105 | SEQ ID NO: 1106 (frame + 2) DDTYTESYISTIGVDFKIRTIDLDGKTIKLQIWDTAGQERFRTITSSYYRGAHGIIVVYDCTDQESFNNLKQWLEEIDRYAC DNVNKLLVGNKCDQTNKKVVDYTQAKEYADQLGIPFLETSAKNATNVEQAF |
| NL021 | 1107 | SEQ ID NO: 1108 (frame + 2) VSLNSVTDISTTFILKPQENVKITLEGAQACFISHERLVISLKGGELYVLTLYSDSMRSVRSFHLEKAAASVLTTCICVCEE NYLFLGSRLGNSLLLRFTEKELNLIEPRAIESSQSQNPAKKKKLDTLGDWMASDVTEIRDLDELEVYGSETQTSMQ1ASY1 F |
| NL022 | 1109 | SEQ ID NO: 1110 (frame + 2) TLHREFLSEPDLQSYSVMIIDEAHERTLHTDILFGLVKDVARFRPDLKLLISSATLDAQKFSEFFDDAPIFRIPGRRFPVDIY YTKAPEADYVDACVVSILQIHATQPLGDILVFLTGQEEIETCQELLQDRVRRLGPRIKELLILPVYSNLPSDMQAKIFLPTPP NARKVVLATNIAETSLTIDNIIYVIDPGFCKQNNFNSRTGMESLVVVPVSKASANQRAGRAGRVAAGKCFRLYT |
| NL023 | 1111 | SEQ ID NO: 1112 (frame + 2) RSFSQERQHEEMKESSGRMHHSDPLIVETHSGHVRGISKTVLGREVHVFTGIPFAKPPIGPLRFRKPVPVDPWHGVLDA TALPNSCYQERYEYFPGFEGEEMWNPNTNLSEDCLYLNIWVPHRLRIRHRANSEENKPRAKVPVLIWIYGGGYMSGTA TLDVYDADMVAATSDVIVASMQYRVGAFGFLYLAQDLPRGSEEAPGNMGLWDQALAIRWLKDNIAAFGGDPELMTLFG ESAGGGSVSIHLVSPITRGLARRGIMQSGTMNAPWSFMTAERATEIAKTLIDDCGCNSSLLTDAPSRVMSCMRSVEAKII SVQQWNSYSGILGLPSAPTIDGIFLPKHPLDLLKEGDFQDTEILIGSNQDEGTYFILYDFIDFFQKDGPSFLQRDKFLDIINT IFKNMTKIEREAIIFQYTDWEHVMDGYLNQKMIGDVVGDYFFICPTNHFAQAFAEHGKKVYYYFFTQRTSTSLWGEWMG VMHGDEIEYVFGHPLNMSLQFNARERDLSLRIMQAYSRFALTGKPVPDDVNWPIYSKDQPQYY1FNAETSGTGRGPRA TACAF |
| NL027 | 1113 | SEQ ID NO: 1114 (frame + 2) PIVLTGSEDGTVRIWHSGTYRLESSLNYGLERVWTICCMRGSNNVALGYDEGSIMVKVGREEPAISMDVNGEKIVWARH SEIQQVNLKAMPEGVEIKDGERLPVAVKDMGSCEIYPQTIAHNPNGRFLVVCGDGEYIIHTSMVLRNKAFGSAQEFIWG QDSSEYAIREGTSTVKVFKNFKEKKSFKPEFGAESIFGGYLLGVCSLSGLALYDWETLELVRRIEIQPKHVYWSESGELV ALATDDSYFVLRYDAQAVLAARDAGDDAVTPDGVEDAFEVLGEVHETVKTGLWVGDCFIYT |

TABLE 3-CS

| Target ID | cDNA SEQ ID NO | Corresponding amino acid sequence of cDNA clone |
|---|---|---|
| CS001 | 1682 | SEQ ID NO: 1683 (frame + 1) KAWMLDKLGGVYAPRPSTGPHKLRECLPLVIFLRNRLKYALTGNEVLKIVKQRLIKVDGKVRTDPTYPAGFMDVV SIEKTNELFRLIYDVKGRFTIHRITPEEAKYKLCKVRRVATGPKNVPYLVTHDGRTVRYPDPLIKVNDSIQLDIATSK IMDFIKFESGNLCMITGGRNLGRVGTIVSRERHPGSFDIVHIRDSTGHTFATRLNNVFIIGKGTKAYISLPRGKGVR LT |
| CS002 | 1684 | SEQ ID NO: 1685 (frame + 1) SFFSKVFGGKKEEKGPSTHEAIQKLRETEELLQKKQEFLERKIDTELQTARKHGTKNKRAAIAALKRKKRYEKQLT QIDGTLTQIEAQREALEGANTNTQVLNTMRDAATAMRLAHKDIDVDKVHDLMDDI |
| CS003 | 1686 | SEQ ID NO: 1687 (frame + 1) GLRNKREVWRVKYTLARIRKAARELLTLEEKDPKRLFEGNALLRRLVRIGVLDEKQMKLDYVLGLKIEDFLERRLQ TQVFKAGLAKSIHHARILIRQRHIRVRKQVVNIPSFIVRLDSGKHIDFSLKSPFGGGRP |
| CS006 | 1688 | SEQ ID NO: 1689 (frame + 1) TCQGMRNALYDKLDDDGIIAPGIRVSGDDVVIGKTITLPENDDELEGTSRRYSKRDASTFLRNSETGIVDQVMLTL NSEGYKFCKIRVRSVRIPQIGDKFASRHGQKGTCGIQYRQEDMPFTCEGLTPDIIINPHAIPSRMTIGHLIECIQGK VSSNKGEIGDATPFNDAVNVQKI |
| CS007 | 1690 | SEQ ID NO: 1691 (frame + 3) SEISCWNQRFWGLSSIAVSSTLQKFNMNVFPKLFWEWIFFVKAKSGMGKTAVFVLATLQQLEPSENHVYVLVMC HTRELAFQISKEYERFSKYMAGVRVSVFFGGMPIQKDEEVLKTACPHIVVGTPGRILALVNNKKLNLKHLKHFILD ECDKMLESLDMRRDVQEIFRNTPHGKQVMMFSATLSKEIRPVCKKFMQDPMEVYVDDEAKLTLHGLQQHYVKL |

TABLE 3-CS-continued

| Target cDNA ID | SEQ ID NO | Corresponding amino acid sequence of cDNA clone |
|---|---|---|
| | | KENEKNKKLFELLDVLEFNQVVIFVKSVQRCIALAQLLTDQNFPAIGIHRNMTQDERLSRYQQFKDFQKRILVATN LFGRGMDIERVNIVFNYDMP |
| CS009 | 1692 | SEQ ID NO: 1693 (frame + 1) LVAICIWTFLQRLDSREPMWQLDESIIGTNPGLGFRPTPPEVASSVIWYKGNDPNSQQFWVQETSNFLTAYKRD GKKAGAGQNIHNCDFKLPPPAGKVCDVDISAWSPCVEDKHFGYHKSTPCIFLKLNKIFGWRPHFYNSSDSLPTD MPDDLKEHIRNMTAYDKNYLNMVWVSCEGENP |
| CS011 | 1694 | SEQ ID NO: 1695 (frame + 1) GSGKTTFVKRHLTGEFEKRYVATLGVEVHPLVFHTNRGPIRFNVWDTAGQEKFGGLRDGYYIQGQCAIIMFDVT SRVTYKNVPNWHRDLVRVCEGIPIVLCGNKVDIKDRKVKAKTIVFHRKKNLQYYDISAKSNYNFEKPFLWLARKLI GDGNLEFVAMQPCFH |
| CS013 | 1696 | SEQ ID NO: 1697 (frame + 2) DAPVVDTAEQVYISSLALLKMLKHGRAGVPMEVMGLMLGEFVDDYTVRVIDVFAMPQTGTGVSVEAVDPVFQA KMLDMLKQTGRPEMVVGWYHSHPGFGCWLSGVDINTQQSFEALSERAVAVVVDPIQSVKG |
| CS014 | 1698 | SEQ ID NO: 1699 (frame + 2) QKQIKHMMAFIEQEANEKAEEIDAKAEEEFNIEKGRLVQQQRLKIMEYYEKKEKQVELQKKIQSSNMLNQARLKV LKVREDHVRNVLDEARKRLAEVPKDVKLYTDLLVTLVVQALFQLMEPTVTVRVRQADVSLVQSILGKAQQDYKA KIKKDVQLKIDTENSLPADTCGGVELIAARGRIKISNTLESRLELIAQQLLPEIRTALF |
| CS015 | 1700 | SEQ ID NO: 1701 (frame + 1) IVLSDDNCPDEKIRMNRVVRNNLRVRLSDIVSIAPCPSVKYGKRVHILPIDDSVEGLTGNLFEVYLKPYFMEAYRPI HRDDTFMVRGGMRAVEFKVVETDPSPYCIVAPDTVIHCEGDPIKREEEEEALNAVGYDDIGGCRKQLAQIKEMV ELPLRHPSLFKAIGVKPPRGILMYGPPGTGKTLIARAVANETGAFFFLINGPEIMSKLAGESESNLRKAFEEADKN SPAIIFIDELDAIAPKREKTHGEVERRIVSQLLTLMDGMKKSSHVIVMAATNRPNSIDPAL |
| CS016 | 1702 | SEQ ID NO: 1703(frame - 3) TPVSEDMLGRVFNGSGKPIDKGPPILAEDFLDIQGQPINPWSRIYPEEMIQTGISAIDVMNSIARGQKIPIFSAAGLP HNEIAAQICRQAGLVKIPGKSVLDDHEDNFAIVFAAMGVNMETARFFKQDFEENGSMENVCLFLNLANDPTIERII TPRLALTAAEFLAYQCEKHVLILTDMSSYAEALREVSAAREEVPGRRGFPGYMYTDLATIYERAGRVEGRNGSI TQIPILTMPNDDITHPIPDLTGYITEGQIYVDRQLHNRQIYPPVNVLPSLSRLMKSAIGEGMTRKDHSDVSNQLYAC YAIGKDVQAMKAVVGEEEALTPDDLLYLEFLTKFEKNFITQGNYENRTVFESLDIGWQLLRIFPKEMLKRIPASI |
| CS018 | 1704 | SEQ ID NO: 1705 (frame + 2) SVYIQPEGVPVPAQQSQQQQSYRHVSESVEHKSYGTQGYTTSEQTKQTQKVAYTNGSDYSSTDDFKVDTFEY RLLREVSFRESITKRYIGETDIQISTEVDKSLGVVTPPKIAQKPRNSKLQEGADAQFQVQLSGNPRPRVSWFKNG QRIVNSNKHEIVTTHNQTILRVRNTQKSDTGNYTLLAENPNGCVVTSAYLAVESPQETYGQDHKSQYIMDNQQT AVEERVEVNEKALAPQFVRVCQDRDVTEGKMTRFDCRVTGRPYPEVTWFINDRQIRDDYXHKILVNESCNHAL MITNVDLSDSGVVSCIARNKTGETSFQCRLNVIEKEQVVAPKFVERFSTLNVREGEPVQLHARAVGTPTPRITWQ KDGVQVIPNPELRINTEGGASTLDIPRAKASDAGWYRC |

TABLE 3-PX

| Target cDNA ID | SEQ ID NO | Corresponding amino acid sequence of cDNA clone |
|---|---|---|
| PX001 | 2100 | SEQ ID NO: 2101 (frame + 1) GPKKHLKRLNAPRAWMLDKLGGVYAPRPSTGPHKLRECLPLVIFLQPPQVRAQRQRGAEDREAAPHQGGRQGPH RPHLPGWIHGCCVD*KDQ*AVPSDLRCEGTLHHPPHHSRGGQVQAVQGEARGDGPQERAVHRDAQRPHAALPRP AHQGQRLHPARHRHLQDHGHHQVRLR*PVHDHGRA*LGASGHHRVPREAPRELRHRPHQGHHRTHLRHQVEQRV HHRQGHE |
| PX009 | 2102 | SEQ ID NO: 2103 (frame + 3) TLIWYKGTGYDSYKYWENQL IDFLSVYKKKGQTAGAGQNIFNCDFRNPPPHGKVCDVDIRGWEPCIDENHFSFHKS SPCIFLKLNKIYGWRPEFYNDTANLPEAMPVDLQTHIRNITAFNRDYANMVWVSCHGETPADKENIGPVRYLPYPGFP GYFYPYENAEGYLSPLVAVHLERPRTGIVINIECKAWA |
| PX010 | 2104 | SEQ ID NO: 2105 (frame + 3) GCIQFITQYQHSSGQRRVRVTTVARNWGDAAANLHHISAGFDQEAAAVVMARLVVYRAEQEDGPDVLRWLDRMLIR LCQKFGEYAKDDPNSFRLSENFSLYPQFMYHLRRSQFLQVFNNSPDETTFYRHMLMREDLTQSLIMIQPILYSYSFG GAPEPVLLDTSSIQPDRILLMDTFFQILIYHGETMAQWRALRYQDMAEYENFKQLLRAPVDDAQEILQTRFPVPRYIDT EHGGSQARFLLSKVNPSQTHNNMYAYGGAMPIPSADGGAPVLTDDVSLQVFMEQP |
| PX015 | 2106 | SEQ ID NO: 2107 (frame + 3) RKETVCIVLSDDNCPDEKIRMNRVVRNNLRVRLSDIVSIAPCPSVKYGKRVHILPIDDSVEGLTGNLFEVYLKPYFMEA YRPIHRDDTFMVRGGMRAVEFKVVETDPSPYCIVAPDTVIHCEGEPIKREEEEEALNAVGYDDIGGCRKQLAQIKEMV ELPLRHPSLFKAIGVKPPRGILMYGPPGTGKTLIARAVANETGAFFFLINGPEIMSKLAGESESNLRKAFEEADKNSPAI ILIDELDAI |
| PX016 | 2108 | SEQ ID NO: 2109 (frame + 2) FTGDILRTPVSEDMLGRIFNGSGKPIDKGPPILAEEYLDIQGQPINPWSRIYPEEMIQTGISAIDVMNSIARGQKIPIFSA AGLPHNEIAAQICRQAGLVKVPGKSVLDDHEDNFAIVFAAMGVNMETARFFKQDFEENGSMENVCLFLNLANDPTIE |

TABLE 3-PX-continued

| Target ID | cDNA SEQ ID NO | Corresponding amino acid sequence of cDNA clone |
|---|---|---|
| | | RIITPRLALTAAEFLAYQCEKHVLVILTDMSSYAEALREVSAAREEVPGRRGFPGYMYTDLATIYERAGRVEGRNGSIT QIPILTMPNDDITHPIPDLTGYITEGQIYVDRQLHNRQIYPPVNVLPSLSRLMKSAIGEGMTRKDHSDVSNQLYACYAIG KDVQAMKAVVGEEALTPDDLLYEFLTKFEKNFITQGSYENRTVFESLDIGWQPLRIFPKEM |

TABLE 3-AD

| Target ID | cDNA SEQ ID NO | Corresponding amino acid sequence of cDNA clone |
|---|---|---|
| AD001 | 2364 | SEQ ID NO: 2365 (frame + 1)<br>GPKKHLKRLNAPKAWMLDKLGGVFAPRPSTGPHKLRECLPLVIFLRNRLKYALTNCEVTKIVMQRLIKVDGKVRTDPN YPAGFMDVVTIEKTGEFFRLVYDVKGRFTIHRISAEEAKYKLCKVRRVQTGPKGIPFLVTHDGRTIRYPDPVIKVNDSI QLDIATCKIMDHIRFESGNLCMITGGRNLGRVGTVVSRERHPGSFDIVHIKDTQGHTFATRLNNVFIIGKATKPYISLPK GKGVKLSIAEERDK |
| AD002 | 2366 | SEQ ID NO: 2367 (frame + 2)<br>SFFSKVFGGKKDGKAPTTGEAIQKLRETEEMLIKKQEFLEKKIEQEINVAKKNGTKNKRAAIQALRKKRYEKQLQQID GTLSTIEMQREALEGANTNTAVLQTMKSAADALKAAHQHMDVDKVHDLMDDI |
| AD009 | 2368 | SEQ ID NO: 2369 (frame + 3)<br>VLAALVAVCLWVFFQTLDPRIPTWQLDSSIIGTSPGLGFRPMPEDSNVESTLIWYRGTDRDDFRQWTDTLDEFLAVY KTPGLTPGRGQNIHNCDYDKPPKKGQVCNVDIKNWHPCIQENHYNYHKSSPCIFIKLNKIYNWIPEYYNESTNLPEQM PEDLKQYIHNLESNNSREMNTVWVSCEGENP |
| AD015 | 2370 | SEQ ID NO: 2371 (frame + 2)<br>DELQLFRGDTVLLKGKRRKETVCIVLSDDTCPDGKIRMNRVVRNNLRVRLSDVVSVQPCPDVKYGKRIHVLPIDDTVE GLTGNLFEVYLKPYFLEAYRPIHKDDAFIVRGGMRAVEFKVVETDPSPYCIVAPDTVIHCEGDPIKREEEEEALNAVGY DDIGGCRKQLAQIKEMVELPLRHPSLFKAIGVKPPRGILLYGPPGTGKTLIARAVANETGAFFFLINGPEIMSKLAGESE SNLRKAFEEADKNAPAIIFIDELDAIAPKREKTHGEVERRIVSQLLTLMDGLKQSSHVIVMAATNRPNSIDGALRRFGRF DREIDIGIPDATGRLEILRIHTKNMKLADDVDLEQIAAESHG |
| AD016 | 2372 | SEQ ID NO: 2373 (frame + 2)<br>FTGDILRVPVSEDMLGRTFNGSGIPIDGGPPIVAETYLDVQGMPINPQTRIYPEEMIQTGISTIDVMTSIARGQKIPIFSG AGLPHNEIAAQICRQAGLVQHKENKDDFAIVFAAMGVNMETARFFKREFAQTGACNVVLFLNLANDPTIERIITPRLAL TVAEFLAYQCNKHVLVIMTDMTSYAEALREVSAAREEVPGRRGFPGYMYTDLSTIYERAGRVQGRPGSITQIPILTMP NDDITHPI |

TABLE 4-LD

| Target ID | SEQ ID NO | Sequences* | Example Gi-number and species |
|---|---|---|---|
| LD001 | 49 | GGCCCCAAGAAGCATTTGAAGCGTTT | 3101175 (Drosophila melanogaster), 92477283 (Drosophila erecta) |
| LD001 | 50 | AATGCCCCAAAAGCATGGATGTTGGATAAA TTGGGAGGTGT | 70909480 (Carabus granulatus), 77325294 (Chironomus tentans), 900945 (Ctenocephalides felis), 60297219 (Diaprepes abbreviatus), 37951951 (Ips pini), 75735533 (Tribolium castaneum), 22039624 (Ctenocephalides felis) |
| LD001 | 51 | GAAGTTACTAAGATTGTTATGCA | 33368080 (Glossina morsitans) |
| LD001 | 52 | ATTGAAAAAACTGGTGAATTTTTCCG | 60297219 (Diaprepes abbreviatus) |
| LD001 | 53 | ACACACGACGGCCGCACCATCCGCT | 27555937 (Anopheles gambiae), 33355008 (Drosophila yakuba), 22474232 (Helicoverpa armigera), 3738704 (Manduca sexta) |
| LD001 | 54 | ACACACGACGGCCGCACCATCCGCTA | 92477283 (Drosophila erecta) |
| LD001 | 55 | CCCAAGAAGCATTTGAAGCGTTTG | 92954810 (Drosophila ananassae), 92231605 (Drosophila willistoni) |
| LD002 | 56 | GCAATGTCATCCATCATGTCGTG | 17861597 (Drosophila melanogaster), 92223378 (Drosophila willistoni), 92471309 (Drosophila erecta) |
| LD003 | 57 | CAGGTTCTTCCTCTTGACGCGTCCAGG | 24975810 (Anopheles gambiae), 3478578 (Antheraea yamamai), 42764756 (Armigeres subalbatus), 24661714 (Drosophila melanogaster), 68267151 (Drosophila simulans), 33355000 (Drosophila yakuba), 49532931 (Plutella xylostella), |

TABLE 4-LD-continued

| Target ID | SEQ ID NO | Sequences* | Example Gi-number and species |
|---|---|---|---|
| | | | 76552910 (*Spodoptera frugiperda*), 92959651 (*Drosophila ananassae*), 92467993 (*Drosophila erecta*) |
| LD003 | 58 | TTGAGCGAGAAGTCAATATGCTTCT | 49558930 (*Boophilus microplus*) |
| LD003 | 59 | TTCCAAGAAATCTTCAATCTTCAAACCCAA | 62238687 (*Diabrotica virgifera*), 76169907 (*Diploptera punctata*), 67872253 (*Drosophila pseudoobscura*), 55877642 (*Locusta migratoria*), 66548956 (*Apis mellifera*) |
| LD003 | 60 | TTCATCCAACACTCCAATACG | 22040140 (*Ctenocephalides felis*) |
| LD003 | 61 | AAGAGCATTGCCTTCAAACAACCT | 2459311 (*Antheraea yamamai*) |
| LD003 | 62 | AGTTCTCTGGCAGCTTTACGGATTTT | 76169907 (*Diploptera punctata*) |
| LD003 | 63 | CCACACTTCACGTTTGTTCCT | 57963694 (*Heliconius melpomene*) |
| LD003 | 64 | CCGTATGAAGCTTGATTACGT | 108742527 (*Gryllus rubens*), 108742525 (*Gryllus pennsylvanicus*), 108742523 (*Gryllus veletis*), 108742521 (*Gryllus bimaculatus*), 108742519 (*Gryllus firmus*), 109194897 (*Myzus persicae*) |
| LD003 | 65 | AGGAACAAACGTGAAGTGTGGCG | 109194897 (*Myzus persicae*) |
| LD006 | 66 | AGCGCTATGGGTAAGCAAGCTATGGG | 27819970 (*Drosophila melanogaster*) |
| LD006 | 67 | TGTTATACTGGTTATAATCAAGAAGAT | 55801622 (*Acyrthosiphon pisum*), 66535130 (*Apis mellifera*) |
| LD007 | 68 | GAAGTTCAGCACGAATGTATTCC | 50563603 (*Homalodisca coagulata*) |
| LD007 | 69 | CAAGCAAGTGATGATGTTCAGTGCCAC | 50563603 (*Homalodisca coagulata*) |
| LD007 | 70 | TGCAAGAAATTCATGCAAGATCC | 21068658 (*Chironomus tentans*) |
| LD007 | 71 | AAATGAAAAGAATAAAAAATT | 49201437 (*Drosophila melanogaster*) |
| LD007 | 72 | CAGAATTTCCCAGCCATAGGAAT | 67895225 (*Drosophila pseudoobscura*) |
| LD007 | 73 | AGCAGTTCAAAGATTTCCAGAAG | 77848709 (*Aedes aegypti*) |
| LD007 | 74 | TTCCAAATCAGCAAAGAGTACGAG | 91083250 (*Tribolium castaneum*) |
| LD010 | 75 | TACCCGCAGTTCATGTACCAT | 29558345 (*Bombyx mori*) |
| LD010 | 76 | CAGTCGCTGATCATGATCCAGCC | 49559866 (*Boophilus microplus*) |
| LD010 | 77 | CTCATGGACACGTTCTTCCAGAT | 60293559 (*Homalodisca coagulata*) |
| LD010 | 78 | GGGGCTGCATACAGTTCATCAC | 92971011 (*Drosophila mojavensis*) |
| LD010 | 79 | CCCGCAGTTCATGTACCATTTG | 92952825 (*Drosophila ananassae*) |
| LD010 | 80 | GACAATGCCAAATACATGAAGAA | 92921253 (*Drosophila virilis*) |
| LD010 | 81 | TTCGATCAGGAGGCAGCCGCAGTG | 92921253 (*Drosophila virilis*) |
| LD011 | 82 | AGCAGGGCTGGCATGGCGACAAA | 28317118 (*Drosophila melanogaster*) |
| LD011 | 83 | TTCTCAAAGTTGTAGTTAGATTTGGC | 37951963 (*Ips pini*) |
| LD011 | 84 | TACTGCAAATTCTTCTTCCTATG | 55883846 (*Locusta migratoria*) |
| LD011 | 85 | GGTACATTCTTGTATGTAACTC | 67885713 (*Drosophila pseudoobscura*) |
| LD011 | 86 | TCAAACATGATAATAGCACACTG | 68771114 (*Acanthoscurria gomesiana*) |
| LD011 | 87 | TCTCCTGACCGGCAGTGTCCCATA | 17944197 (*Drosophila melanogaster*), 77843537 (*Aedes aegypti*), 94469127 (*Aedes aegypti*), 24664595 (*Drosophila melanogaster*) |
| LD011 | 88 | GCTACTTTGGGAGTTGAAGTCCATCC | 101410627 (*Plodia interpuntella*) |
| LD011 | 89 | TAACTACAACTTTGAGAAGCCTTTCCT | 90813103 (*Nasonia vitripennis*) |
| LD011 | 90 | AAGTTTGGTGGTCTCCGTGATGG | 84267747 (*Aedes aegypti*) |

TABLE 4-LD-continued

| Target ID | SEQ ID NO | Sequences* | Example Gi-number and species |
|---|---|---|---|
| LD014 | 91 | GCAGATCAAGCATATGATGGC | 9732 (Manduca sexta), 90814338 (Nasonia vitripennis), 87266590 (Choristoneura fumiferana) |
| LD014 | 92 | ATCAAGCATATGATGGCTTTCATTGA | 75470953 (Tribolium castaneum), 76169390 (Diploptera punctata) |
| LD014 | 93 | AATATTGAAAAGGGGCGCCTTGT | 78055682 (Heliconius erato) |
| LD014 | 94 | CAACGTCTCAAGATTATGGAATA | 37659584 (Bombyx mori) |
| LD014 | 95 | ATTATGGAATATTATGAGAAGAAAGA | 66556286 (Apis mellifera) |
| LD014 | 96 | AACAAATCAAGATCAGCAATACT | 25958976 (Curculio glandium) |
| LD016 | 97 | ATGTCGTCGTTGGGCATAGTCA | 27372076 (Spodoptera littoralis) |
| LD016 | 98 | GTAGCTAAATCGGTGTACATGTAACCTGGGAAACCACGACG | 27372076 (Spodoptera littoralis), 55797015 (Acyrthosiphon pisum), 73615307 (Aphis gossypii), 4680479 (Aedes aegypti), 9713 (Manduca sexta), 76555122 (Spodoptera frugiperda), 237458 (Heliothis virescens), 53883819 (Plutella xylostella), 22038926 (Ctenocephalides felis), 101403557 (Plodia interpuntella), 92969578 (Drosophila grimshawi), 91829127 (Bornbyx mori) |
| LD016 | 99 | GCAGATACCTCACGCAAAGCTTC | 62239897 (Diabrotica virgifera) |
| LD016 | 100 | GGATCGTTGGCCAAATTCAAGAACAGGCA | 67882712 (Drosophila pseudoobscura), 92985459 (Drosophila grimshawi) |
| LD016 | 101 | TTCTCCATAGAACCGTTCTCTTCGAAATCCTG | 4680479 (Aedes aegypti), 27372076 (Spodoptera littoralis) |
| LD016 | 102 | GCTGTTTCCATGTTAACACCCAT | 49558344 (Boophilus microplus) |
| LD016 | 103 | TCCATGTTAACACCCATAGCAGCGA | 62238871 (Diabrotica virgifera) |
| LD016 | 104 | CTACAGATCTGGGCAGCAATTTCATTGTG | 22038926 (Ctenocephalides felis), 16898595 (Ctenocephalides felis) |
| LD016 | 105 | GGCAGACCAGCTGCAGAGAAAAT | 22038926 (Ctenocephalides felis), 16898595 (Ctenocephalides felis) |
| LD016 | 106 | GAGAAAATGGGGATCTTCTGACCACGAGCAATGGAGTTCATCACGTC | 4680479 (Aedes aegypti), 9713 (Manduca sexta), 22038926 (Ctenocephalides felis), 16898595 (Ctenocephalides felis), 67877903 (Drosophila pseudoobscura), 10763875 (Manduca sexta), 76554661 (Spodoptera frugiperda), 77905105 (Aedes aegypti), 50562965 (Homalodisca coagulate), 27372076 (Spodoptera littoralis) |
| LD016 | 107 | ATGGAGTTCATCACGTCAATAGC | 9713 (Manduca sexta), 237458 (Heliothis virescens), 76554661 (Spodoptera frugiperda), 22474331 (Helicoverpa armigera) |
| LD016 | 108 | GTCTGGATCATTTCCTCAGGATAGATACGGGACCACGGATTGATTGGTTGACCCTGGATGTCCAAGAAGTCTTCAGCCAAATTGGGGACCTTTGTC | 16898595 (Ctenocephalides felis), 22038926 (Ctenocephalides felis), 50562965 (Homalodisca coagulate), 49395165 (Drosophila melanogaster), 6901845 (Bombyx mori), 92931000 (Drosophila virilis) |
| LD016 | 109 | ATTGGGGACCTTTGTCGATGGG | 10763875 (Manduca sexta) |
| LD016 | 110 | ATGGGTTTTCCTGATCCATTGAAAACACGTCCCAACATATCTTCAGAAACAGGAGTCCTCAAATATCTCCTGTGAATTCACAAGCGGTGTTTTTGGCGTCGATTCCTGATGTGCCCTCGAACACTTGAACCACAGCTTT | 49395165 (Drosophila melanogaster), 55905051 (Locusta migratoria) |
| LD016 | 111 | ACAGCTTTTGACCCACTGACTTCCAG | 21642266 (Amblyomma variegatum) |
| LD016 | 112 | GACCCACTGACTTCCAGAACTTGTCCCGAACGTATAGTGCCATCAGCCAGTTTGAGT | 49395165 (Drosophila melanogaster) |
| LD016 | 113 | GGACCGTTCACACCAGACACAGT | 24646342 (Drosophila melanogaster) |

TABLE 4-LD-continued

| Target ID | SEQ ID NO | Sequences* | Example Gi-number and species |
|---|---|---|---|
| LD016 | 114 | GACTGTGTCTGGTGTGAACGGTCCTCT | 103769163 (*Drosophila melanogaster*), 92048971 (*Drosophila willistoni*) |
| LD016 | 115 | TTCTCTTCGAAATCCTGTTTGAA | 84116133 (*Dermatophagoides farinae*) |
| LD016 | 116 | GACTGTGTVTGGTGTGAACGGTCC | 24646342 (*Drosophila melanogaster*) |
| LD016 | 117 | GGTCGTCGTGGTTTCCCAGGTTACATGTACACCGATTT | 92231646 (*Drosophila willistoni*), 91755555 (*Bombyx mori*), 84228226 (*Aedes aegypti*) |
| LD016 | 118 | TGACAGCTGCCGAATTCTTGGC | 92231646 (*Drosophila willistoni*) |
| LD018 | 119 | CAAGTCACCGACGACCACAACCACAA | 91080016 (*Tribolium castaneum*) |
| LD018 | 120 | ATCGCGATTGACGGTGGAGCC | 91080016 (*Tribolium castaneum*) |
| LD027 | 121 | AGACGATCGGTTGGTTAAAATC | 66501387 (*Apis mellifera*) |
| LD027 | 122 | GATATGGGAGCATGTGAAATATA | 77326476 (*Chironomus tentans*) |
| LD027 | 123 | TTAGAGAATTGTTTGAATTAT | 90129719 (*Bicyclus anynana*) |

TABLE 4-PC

| Target ID | SEQ ID NO | Sequence * | Example Gi-number and species |
|---|---|---|---|
| PC001 | 275 | AAAATTGTCATGCAAAGGTTGAT | 37952206 (*Ips pini*) |
| PC001 | 276 | AAAGCATGGATGTTGGACAAA | 98994282 (*Antheraea mylitta*) 109978109 (*Gryllus pennsylvanicus*) 55904580 (*Locusta migratoria*) |
| PC001 | 277 | AAAGCATGGATGTTGGACAAATT | 31366663 (*Toxoptera citricida*) |
| PC001 | 278 | AAAGCATGGATGTTGGACAAATTGGG | 60311985 (*Papilio dardanus*) |
| PC001 | 279 | AAAGCATGGATGTTGGACAAATTGGGGGTGT | 37951951 (*Ips pini*) |
| PC001 | 280 | AAATACAAGTTGTGTAAAGTAA | 84647793 (*Myzus persicae*) |
| PC001 | 281 | AAGCATGGATGTTGGACAAATTGGGGGTGT | 70909486 (*Mycetophagus quadripustulatus*) |
| PC001 | 282 | ATGGATGTCATTACTATTGAGAA | 25957367 (*Carabus granulatus*) |
| PC001 | 283 | CATCAAATTTGAATCTGGCAACCT | 37952206 (*Ips pini*) |
| PC001 | 284 | CATGATGGCAGAACCATTCGTTA | 60303405 (*Julodis onopordi*) |
| PC001 | 285 | CCAAAGCATGGATGTTGGACAA | 90138164 (*Spodoptera frugiperda*) |
| PC001 | 286 | CCATTTTTGGTAACACATGATGG | 111011915 (*Apis mellifera*) |
| PC001 | 287 | CCCAAAGCATGGATGTTGGACAA | 50565112 (*Homalodisca coagulata*) |
| PC001 | 288 | CCCAAAGCATGGATGTTGGACAAA | 103790417 (*Heliconius erato*) 101419954 (*Plodia interpunctella*) |
| PC001 | 289 | CCCAAAGCATGGATGTTGGACAAATT | 73612809 (*Aphis gossypii*) |
| PC001 | 290 | CCCAAAGCATGGATGTTGGACAAATTGGG | 77329254 (*Chironomus tentans*) |
| PC001 | 291 | CCCAAAGCATGGATGTTGGACAAATTGGGGGTGT | 60305420 (*Mycetophagus quadripustulatus*) |
| PC001 | 292 | CCCAAAGCATGGATGTTGGACAAATTGGGGGTGTCTTCGC | 84647995 (*Myzus persicae*) |
| PC001 | 293 | CGTTACCCTGACCCCAACATCAA | 73613065 (*Aphis gossypii*) |
| PC001 | 294 | GCAAAATACAAGTTGTGTAAAGTAA | 83662334 (*Myzus persicae*) |
| PC001 | 295 | GCATGGATGTTGGACAAATTGGG | 92969396 (*Drosophila grimshawi*) |
| PC001 | 296 | GCATGGATGTTGGACAAATTGGGG | 67885868 (*Drosophila pseudoobscura*) |

TABLE 4-PC-continued

| Target ID | SEQ ID NO | Sequence * | Example Gi-number and species |
|---|---|---|---|
| PC001 | 297 | GCATGGATGTTGGACAAATTGGGGGTGT | 25956479 (Biphyllus lunatus) |
| PC001 | 298 | GCATGGATGTTGGACAAATTGGGGGTGTCT | 90814901 (Nasonia vitripennis) |
| PC001 | 299 | GCTCCCAAAGCATGGATGTTGGA | 110260785 (Spodoptera frugiperda) |
| PC001 | 300 | GCTCCCAAAGCATGGATGTTGGACAA | 76551269 (Spodoptera frugiperda) |
| PC001 | 301 | GCTCCCAAAGCATGGATGTTGGACAAA | 56085210 (Bombyx mori) |
| PC001 | 302 | GCTCCCAAAGCATGGATGTTGGACAAATTGGG | 22474232 (Helicoverpa armigera) |
| PC001 | 303 | GGTCCCAAAGGAATCCCATTTTTGGT | 50565112 (Homalodisca coagulata) |
| PC001 | 304 | GGTGTCTTCGCCCCTCGTCCA | 82575022 (Acyrthosiphon pisum) |
| PC001 | 305 | GTGAAGTCACTAAAATTGTCATGCAAAG | 25956820 (Biphyllus lunatus) |
| PC001 | 306 | TCCACCGGGCCTCACAAGTTGCG | 58371410 (Lonomia obliqua) |
| PC001 | 307 | TCCCAAAGCATGGATGTTGGA | 110263957 (Spodoptera frugiperda) |
| PC001 | 308 | TGCTCCCAAAGCATGGATGTTGGACAA | 48927129 (Hydropsyche sp.) |
| PC001 | 309 | TGGATGTTGGACAAATTGGGGGTGTCT | 90814560 (Nasonia vitripennis) |
| PC003 | 310 | AAAATTGAAGATTTCTTGGAA | 108742519 (Gryllus firmus)<br>109978291 (Gryllus pennsylvanicus)<br>62083482 (Lysiphlebus testaceipes)<br>56150446 (Rhynchosciara americana) |
| PC003 | 311 | AACAAACGTGAAGTGTGGAGAGT | 57963755 (Heliconius melpomene) |
| PC003 | 312 | AAGTCGCCCTTCGGGGTGGCCG | 77884026 (Aedes aegypti) |
| PC003 | 313 | ACTTCTCCCTGAAGTCGCCCTTCGG | 92992453 (Drosophila mojavensis) |
| PC003 | 314 | AGATTGTTTGAAGGTAATGCACTTCT | 60298816 (Diaphorina citri) |
| PC003 | 315 | ATCCGTAAAGCTGCTCGTGAA | 33373689 (Glossina morsitans) |
| PC003 | 316 | ATCGACTTCTCCCTGAAGTCGCC | 92987113 (Drosophila grimshawi) |
| PC003 | 317 | ATCGACTTCTCCCTGAAGTCGCCCT | 1899548 (Drosophila melanogaster) |
| PC003 | 318 | ATGAAGCTTGATTATGTTTGGGTCTGAAAATTGAAGATTTCTTGGAAAGA | 71539459 (Diaphorina citri) |
| PC003 | 319 | ATTGAAGATTTCTTGGAAAGA | 62240069 (Diabrotica virgifera) |
| PC003 | 320 | CACATCGACTTCTCCCTGAAGTC | 71550961 (Oncometopia nigricans) |
| PC003 | 321 | CAGAAGCACATCGACTTCTCCCTGAAGTCGCCCTTCGG | 68267151 (Drosophila simulans)<br>33355000 (Drosophila yakuba) |
| PC003 | 322 | CAGAAGCACATCGACTTCTCCCTGAAGTCGCCCTTCGGGGG | 2152719 (Drosophila melanogaster) |
| PC003 | 323 | CGACTTCTCCCTGAAGTCGCC | 107324644 (Drosophila melanogaster) |
| PC003 | 324 | CTCCCTGAAGTCGCCCTTCGG | 15461311 (Drosophila melanogaster) |
| PC003 | 325 | CTGGACTCGCAGAAGCACATCGACTTCTCCCTGAA | 38624772 (Drosophila melanogaster) |
| PC003 | 326 | GACTTCTCCCTGAAGTCGCCCTTCGG | 92959651 (Drosophila ananassae)<br>92981958 (Drosophila mojavensis)<br>76552467 (Spodoptera frugiperda) |
| PC003 | 327 | GCTAAAATCCGTAAAGCTGCTCGTGA | 60296953 (Diaprepes abbreviatus) |
| PC003 | 328 | GCTAAAATCCGTAAAGCTGCTCGTGAACT | 77329341 (Chironomus tentans) |
| PC003 | 329 | GTGCGCAAGCAGGTGGTGAACATCCC | 60312414 (Papilio dardanus) |
| PC003 | 330 | TACACTTTGGCTAAAATCCGTAAAGCTGC | 22040140 (Ctenocephalides felis) |
| PC003 | 331 | TCGCAGAAGCACATCGACTTCTC | 18883211 (Anopheles gambiae) |

TABLE 4-PC-continued

| Target ID | SEQ ID NO | Sequence * | Example Gi-number and species |
|---|---|---|---|
| PC003 | 332 | TCGCAGAAGCACATCGACTTCTCCCTGAAGTCGCCCTTCGG | 92963738 (*Drosophila grimshawi*) |
| PC003 | 333 | TCTCCCTGAAGTCGCCCTTCGG | 38047836 (*Drosophila yakuba*) <br> 27260897 (*Spodoptera frugiperda*) |
| PC003 | 334 | TGAAAATTGAAGATTTCTTGGAA | 61646980 (*Acyrthosiphon pisum*) <br> 73615225 (*Aphis gossypii*) <br> 83661890 (*Myzus persicae*) <br> 37804775 (*Rhopalosiphum padi*) <br> 30049209 (*Toxoptera citricida*) |
| PC003 | 335 | TGAAAATTGAAGATTTCTTGGAAAGA | 90813959 (*Nasonia vitripennis*) |
| PC003 | 336 | TGGACTCGCAGAAGCACATCGACTTCTCCCT | 25959408 (*Meladema coriacea*) |
| PC003 | 337 | TGGCTAAAATCCGTAAAGCTGC | 76169907 (*Diploptera punctata*) |
| PC003 | 338 | TGGGTCTGAAAATTGAAGATTTCTTGGA | 34788046 (*Callosobruchus maculatus*) |
| PC003 | 339 | TTCTCCCTGAAGTCGCCCTTCGG | 107331362 (*Drosophila melanogaster*) <br> 110240861 (*Spodoptera frugiperda*) |
| PC003 | 340 | TTGGGTCTGAAAATTGAAGATTTCTTGGAAAG | 37952462 (*Ips pini*) |
| PC003 | 341 | GGGTGCGCAAGCAGGTGGTGAAC | 110887729 (*Argas monolakensis*) |
| PC005 | 342 | CTCCTCAAAAAGTACAGGGAGGCCAAGAA | 63512537 (*Ixodes scapularis*) |
| PC005 | 343 | AAAAGAAGGTGTGGTTGGATCC | 33491424 (*Trichoplusia ni*) |
| PC005 | 344 | AAAAGAAGGTGTGGTTGGATCCAAATGAAATCAA | 91759273 (*Bombyx mori*) <br> 55908261 (*Locusta migratoria*) |
| PC005 | 345 | AAAGAAGGTGTGGTTGGATCCAAATGAAATCA | 101414616 (*Plodia interpunctella*) |
| PC005 | 346 | AACACCAACTCAAGACAAAACAT | 25957531 (*Cicindela campestris*) |
| PC005 | 347 | AACACCAACTCAAGACAAAACATCCGTAA | 25958948 (*Curculio glandium*) |
| PC005 | 348 | AACTCAAGACAAAACATCCGTAA | 60314333 (*Panorpa cf. vulgaris APV-2005*) |
| PC005 | 349 | AAGAACACTGAAGCCAGAAGGAAGGGAAGGCATTGTGG | 25958948 (*Curculio glandium*) |
| PC005 | 350 | AATGAAATCAACGAAATCGCCAACAC | 92979160 (*Drosophila grimshawi*) <br> 92232072 (*Drosophila willistoni*) |
| PC005 | 351 | ATGGAGTACATCCACAAGAAGAAGGC | 15454802 (*Drosophila melanogaster*) |
| PC005 | 352 | CAAGATGCTGTCTGACCAGGC | 67872905 (*Drosophila pseudoobscura*) |
| PC005 | 353 | CGCCTCCTCAAAAAGTACAGGGAGGC | 75471260 (*Tribolium castaneum*) |
| PC005 | 354 | CGTATCGCCACCAAGAAGCAG | 68267374 (*Drosophila simulans*) |
| PC005 | 355 | CTGTACATGAAAGCGAAGGGTAA | 25957246 (*Carabus granulatus*) |
| PC005 | 356 | GAACAAGAGGGTCCTTATGGAG | 90977107 (*Aedes aegypti*) |
| PC005 | 357 | GAACAAGAGGGTCCTTATGGAGTACATCCA | 40544432 (*Tribolium castaneum*) |
| PC005 | 358 | GAGCGTATCGCCACCAAGAAGCA | 92480972 (*Drosophila erecta*) <br> 33354497 (*Drosophila yakuba*) |
| PC005 | 359 | GAGTACATCCACAAGAAGAAGGC | 15516174 (*Drosophila melanogaster*) |
| PC005 | 360 | GATCCAAATGAAATCAACGAAAT | 56149737 (*Rhynchosciara americana*) |
| PC005 | 361 | GCCAACACCAACTCAAGACAAAACATCCG | 103019061 (*Tribolium castaneum*) |
| PC005 | 362 | GCCAACACCAACTCAAGACAAAACATCCGTAAGCTCAT | 56149737 (*Rhynchosciara americana*) |
| PC005 | 363 | GGCAAAAGAAGGTGTGGTTGGATCCAAATGAAATCA | 101417042 (*Plodia interpunctella*) |
| PC005 | 364 | GGGTCCTTATGGAGTACATCCACAAGAA | 67885759 (*Drosophila pseudoobscura*) |
| PC005 | 365 | TGCGATGCGGCAAAAGAAGGT | 56149531 (*Rhynchosciara americana*) |

TABLE 4-PC-continued

| Target ID | SEQ ID NO | Sequence * | Example Gi-number and species |
|---|---|---|---|
| PC005 | 366 | TGGTTGGATCCAAATGAAATCAACGAAAT | 15355452 (*Apis mellifera*) <br> 83662749 (*Myzus persicae*) |
| PC005 | 367 | TTGGATCCAAATGAAATCAACGAAAT | 110985444 (*Apis mellifera*) <br> 111158439 (*Myzus persicae*) |
| PC010 | 368 | CCGCAGTTCATGTACCATTTG | 92952825 (*Drosophila ananassae*) |
| PC010 | 369 | CTGATGGAGATGAAGCAGTGCTGCAATTC | 58395529 (*Anopheles gambiae* str. PEST) |
| PC010 | 370 | GACGTGCTCAGATGGGTGGACAG | 56152422 (*Rhynchosciara americana*) |
| PC010 | 371 | GCCCGAGCCTGTGTTGTTGGA | 92939820 (*Drosophila virilis*) |
| PC010 | 372 | GGCACATGCTGATGCGTGAGGAT | 83937570 (*Lutzomyia longipalpis*) |
| PC010 | 373 | GGGCACATGGTCATGGGCGATTC | 3337934 (*Drosophila melanogaster*) |
| PC014 | 374 | AAGATCATGGAGTACTACGAGAA | 85577611 (*Aedes aegypti*) |
| PC014 | 375 | ACGAGAAAAAGGAGAAGCAAG | 67838315 (*Drosophila pseudoobscura*) |
| PC014 | 376 | ATGGAGTACTACGAGAAAAGGAGAAGCAAGT | 92928915 (*Drosophila virilis*) |
| PC014 | 377 | CAAAAACAAATCAAACACATGATGGC | 82574001 (*Acyrthosiphon pisum*) <br> 111160670 (*Myzus persicae*) |
| PC014 | 378 | CTCAAGATCATGGAGTACTACGA | 55692554 (*Drosophila yakuba*) |
| PC014 | 379 | CTCAAGATCATGGAGTACTACGAGAA | 92942301 (*Drosophila ananassae*) <br> 92476196 (*Drosophila erecta*) <br> 53884266 (*Plutella xylostella*) |
| PC014 | 380 | GAACAAGAAGCCAATGAGAAAGC | 111160670 (*Myzus persicae*) |
| PC014 | 381 | GACTCAAGATCATGGAGTACT | 112432414 (*Myzus persicae*) |
| PC014 | 382 | GATGTTCAAAAACAAATCAAACACATGATGGC | 73618688 (*Aphis gossypii*) |
| PC014 | 383 | TACTACGAGAAAAAGGAGAAGC | 62239529 (*Diabrotica virgifera*) |
| PC014 | 384 | TTCATTGAACAAGAAGCCAATGA | 15357365 (*Apis mellifera*) |
| PC016 | 385 | ACACGACCGGCGCGCTCGTAAAT | 75710699 (*Tribolium castaneum*) |
| PC016 | 386 | ACCAGCACGTGCTTCTCGCACTGGTAGGCCAAGAATTCGGC | 92048971 (*Drosophila willistoni*) |
| PC016 | 387 | AGCACGTGCTTCTCGCACTGGTAGGC | 92985459 (*Drosophila grimshawi*) |
| PC016 | 388 | ATACGCGACCACGGGTTGATCGG | 18868609 (*Anopheles gambiae*) <br> 31206154 (*Anopheles gambiae* str. PEST) |
| PC016 | 389 | ATCGGTGTACATGTAACCGGGGAAACC | 2921501 (*Culex pipiens*) <br> 62239897 (*Diabrotica virgifera*) <br> 92957249 (*Drosophila ananassae*) <br> 92477818 (*Drosophila erecta*) <br> 92965644 (*Drosophila grimshawi*) <br> 24646342 (*Drosophila melanogaster*) <br> 67896654 (*Drosophila pseudoobscura*) <br> 75710699 (*Tribolium castaneum*) |
| PC016 | 390 | ATCGTTGGCCAAGTTCAAGAACAG | 92950254 (*Drosophila ananassae*) |
| PC016 | 391 | CACGTGCTTCTCGCACTGGTAGGCCAAGAA | 4680479 (*Aedes aegypti*) |
| PC016 | 392 | CCAGTCTGGATCATTTCCTCGGG | 67884189 (*Drosophila pseudoobscura*) |
| PC016 | 393 | CCAGTCTGGATCATTTCCTCGGGATA | 92940287 (*Drosophila virilis*) |
| PC016 | 394 | CGCTCGATGGTCGGATCGTTGGCCAAGTTCAAGAACA | 2921501 (*Culex pipiens*) |
| PC016 | 395 | CGCTCGATGGTCGGATCGTTGGCCAAGTTCAAGAACAGACACACGTTCTCCAT | 92477818 (*Drosophila erecta*) <br> 15061308 (*Drosophila melanogaster*) |
| PC016 | 396 | CGTGCTTCTCGCACTGGTAGGCCAAGAA | 13752998 (*Drosophila melanogaster*) |
| PC016 | 397 | CTGGCAGTTTCCATGTTGACACCCATAGC | 16898595 (*Ctenocephalides felis*) |

TABLE 4-PC-continued

| Target ID | SEQ ID NO | Sequence * | Example Gi-number and species |
|---|---|---|---|
| PC016 | 398 | CTTAGCATCAATACCTGATGT | 61646107 (*Acyrthosiphon pisum*) |
| PC016 | 399 | GACATGTCGGTCAAGATGACCAGCACGTG | 9713 (*Manduca sexta*) |
| PC016 | 400 | GACATGTCGGTCAAGATGACCAGCACGTGCTTCTCGCACTG | 92933153 (*Drosophila virilis*) |
| PC016 | 401 | GACATGTCGGTCAAGATGACCAGCACGTGCTTCTCGCACTGGTA | 2921501 (*Culex pipiens*) |
| PC016 | 402 | GAGCCGTTCTCTTCGAAGTCCTG | 237458 (*Heliothis virescens*) |
| PC016 | 403 | GATGACCAGCACGTGCTTCTC | 18883474 (*Anopheles gambiae*) |
| PC016 | 404 | GATGACCAGCACGTGCTTCTCGCACTG | 92477818 (*Drosophila erecta*) |
| PC016 | 405 | GATGACCAGCACGTGCTTCTCGCACTGGTAGGCCAAGAA | 15061308 (*Drosophila melanogaster*)<br>67883622 (*Drosophila pseudoobscura*) |
| PC016 | 406 | GATGACCAGCACGTGCTTCTCGCACTGGTAGGCCAAGAATTCGGC | 31206154 (*Anopheles gambiae* str. PEST) |
| PC016 | 407 | GATGGGGATCTGCGTGATGGA | 101403557 (*Plodia interpunctella*) |
| PC016 | 408 | GATGGGGATCTGCGTGATGGAGCCGTTGCGGCCCTCCAC | 53883819 (*Plutella xylostella*) |
| PC016 | 409 | GGAATAGGATGGGTGATGTCGTCGTTGGGCATAGT | 110240379 (*Spodoptera frugiperda*) |
| PC016 | 410 | GGAATAGGATGGGTGATGTCGTCGTTGGGCATAGTCA | 27372076 (*Spodoptera littoralis*) |
| PC016 | 411 | GGATCGTTGGCCAAGTTCAAGAA | 91757299 (*Bombyx mori*) |
| PC016 | 412 | GGATCGTTGGCCAAGTTCAAGAACA | 103020368 (*Tribolium castaneum*) |
| PC016 | 413 | GGATCGTTGGCCAAGTTCAAGAACAG | 237458 (*Heliothis virescens*) |
| PC016 | 414 | GGATGGGTGATGTCGTCGTTGGGCAT | 101403557 (*Plodia interpunctella*) |
| PC016 | 415 | GGCAGTTTCCATGTTGACACCCATAGC | 4680479 (*Aedes aegypti*) |
| PC016 | 416 | GGCATAGTCAAGATGGGGATCTG | 92924977 (*Drosophila virilis*) |
| PC016 | 417 | GTCTGGATCATTTCCTCGGGATA | 92966144 (*Drosophila grimshawi*) |
| PC016 | 418 | GTGATGATGCGCTCGATGGTCGGATCGTTGGCCAAGTTCAAGAACAGACACACGTTCTCCAT | 15514750 (*Drosophila melanogaster*) |
| PC016 | 419 | GTGTACATGTAACCGGGGAAACC | 92924977 (*Drosophila virilis*) |
| PC016 | 420 | GTTTCCATGTTGACACCCATAGC | 91826756 (*Bombyx mori*) |
| PC016 | 421 | TCAATGGGTTTTCCTGATCCATTGAA | 49395165 (*Drosophila melanogaster*)<br>99009492 (*Leptinotarsa decemlineata*) |
| PC016 | 422 | TCATCCAGCACAGACTTGCCAG | 10763875 (*Manduca sexta*) |
| PC016 | 423 | TCATCCAGCACAGACTTGCCAGG | 9713 (*Manduca sexta*) |
| PC016 | 424 | TCCATGTTGACACCCATAGCAGC | 92962756 (*Drosophila ananassae*) |
| PC016 | 425 | TCCATGTTGACACCCATAGCAGCAAACAC | 60295607 (*Homalodisca coagulata*) |
| PC016 | 426 | TCGAAGTCCTGCTTGAAGAACCTGGC | 101403557 (*Plodia interpunctella*) |
| PC016 | 427 | TCGATGGTCGGATCGTTGGCCAAGTTCAAGAACAGACACACGTTCTCCAT | 4680479 (*Aedes aegypti*) |
| PC016 | 428 | TCGGATCGTTGGCCAAGTTCAAGAACAGACACACGTTCTCCAT | 2793275 (*Drosophila melanogaster*) |
| PC016 | 429 | TCGTTGGCCAAGTTCAAGAACAG | 90137502 (*Spodoptera frugiperda*) |
| PC016 | 430 | TGGGTGATGTCGTCGTTGGGCAT | 53883819 (*Plutella xylostella*) |
| PC016 | 431 | TTCTCGCACTGGTAGGCCAAGAA | 110240379 (*Spodoptera frugiperda*)<br>27372076 (*Spodoptera littoralis*) |
| PC016 | 432 | TTCTCTTCGAAGTCCTGCTTGAAGAACCTGGC | 9713 (*Manduca sexta*) |

TABLE 4-PC-continued

| Target ID | SEQ ID NO | Sequence * | Example Gi-number and species |
|---|---|---|---|
| PC016 | 433 | TTGGCCAAGTTCAAGAACAGACACACGTT | 55905051 (*Locusta migratoria*) |
| PC016 | 434 | GTTTCCATGTTGACACCCATAGCAGCAAA | 84116133 (*Dermatophagoides farinae*) |

TABLE 4-EV

| Target ID | SEQ ID NO | Sequence * | Example Gi-number and species |
|---|---|---|---|
| EV005 | 533 | AAGCGACGTGAAGAGCGTATCGC | 76553206 (*Spodoptera frugiperda*) |
| EV005 | 534 | ATTAAAGATGGTCTTATTATTAA | 15355452 (*Apis mellifera*) |
| EV005 | 535 | CGTAAGCGACGTGAAGAGCGTATCGC | 33491424 (*Trichoplusia ni*) |
| EV005 | 536 | GGTCGTCATTGTGGATTTGGTAAAAG | 60314333 (*Panorpa cf. vulgaris* APV-2005) |
| EV005 | 537 | TGCGATGCGGCAAGAAGAAGGT | 15048930 (*Drosophila melanogaster*) |
| EV005 | 538 | TGCGGCAAGAAGAAGGTTTGG | 93002524 (*Drosophila mojavensis*)<br>92930455 (*Drosophila virilis*)<br>92044532 (*Drosophila willistoni*) |
| EV005 | 539 | TTGTGGATTTGGTAAAAGGAA | 60306723 (*Sphaerius* sp.) |
| EV010 | 540 | CAAGTGTTCAATAATTCACCA | 83937567 (*Lutzomyia longipalpis*) |
| EV010 | 541 | CATTCTATAGGCACATGTTGATG | 29558345 (*Bombyx mori*) |
| EV010 | 542 | CTGGCGGCCACATGGTCATGGG | 92476940 (*Drosophila erecta*)<br>92977931 (*Drosophila grimshawi*)<br>2871327 (*Drosophila melanogaster*) |
| EV015 | 543 | AACAGGCCCAATTCCATCGACCC | 92947821 (*Drosophila ananassae*) |
| EV015 | 544 | AGAGAAAAATGGACCTCATCGAC | 62239128 (*Diabrotica virgifera*) |
| EV015 | 545 | CGCCATCCGTCGCTGTTCAAGGCGATCGG | 18866954 (*Anopheles gambiae*) |
| EV015 | 546 | CTGGCAGTTACCATGGAGAACTTCCGTTACGCCATG | 62239128 (*Diabrotica virgifera*) |
| EV015 | 547 | GTGATCGTGATGGCGGCCACGAA | 18887285 (*Anopheles gambiae*) |
| EV015 | 548 | GTGATCGTGATGGCGGCCACGAAC | 83423460 (*Bombyx mori*) |
| EV015 | 549 | TGATGGACGGCATGAAGAAAAG | 91086234 (*Tribolium castaneum*) |
| EV016 | 550 | AATATGGAAACAGCCAGATTCTT | 109193659 (*Myzus persicae*) |
| EV016 | 551 | ATGATCCAGACTGGTATTTCTGC | 92938857 (*Drosophila virilis*) |
| EV016 | 552 | ATTGATGTGATGAATTCCATTGCC | 55905051 (*Locusta migratoria*) |
| EV016 | 553 | GAAATGATCCAGACTGGTATTTCTGC | 50562965 (*Homalodisca coagulata*) |
| EV016 | 554 | GAAGAAATGATCCAGACTGGTAT | 92969748 (*Drosophila mojavensis*) |
| EV016 | 555 | GACTGTGTCTGGTGTGAACGG | 2286639 (*Drosophila melanogaster*)<br>92042621 (*Drosophila willistoni*) |
| EV016 | 556 | GATATGTTGGGTCGTGTGTTTAA | 92969748 (*Drosophila mojavensis*) |
| EV016 | 557 | GATCCTACCATTGAAAGAATTAT | 99011193 (*Leptinotarsa decemlineata*) |
| EV016 | 558 | GTGTCTGAAGATATGTTGGGTCGTGT | 76554661 (*Spodoptera frugiperda*) |
| EV016 | 559 | GTGTCTGGTGTGAACGGACCG | 22474331 (*Helicoverpa armigera*) |
| EV016 | 560 | TCTGAAGATATGTTGGGTCGTGT | 27372076 (*Spodoptera littoralis*) |
| EV016 | 561 | TGGCATATCAATGTGAGAAGCA | 60336595 (*Homalodisca coagulata*) |
| EV016 | 562 | TTGAACTTGGCCAATGATCCTACCAT | 91827863 (*Bombyx mori*) |

TABLE 4-AG

| Target ID | SEQ ID NO | Sequence * | Example Gi-number and species |
|---|---|---|---|
| AG001 | 621 | AAAACTGGTGAATTCTTCCGTTTGAT | 37953169 (*Ips pini*) |
| AG001 | 622 | AAAGCATGGATGTTGGACAAA | 98994282 (*Antheraea mylitta*)<br>109978109 (*Gryllus pennsylvanicus*)<br>55904580 (*Locusta migratoria*) |
| AG001 | 623 | AAAGCATGGATGTTGGACAAATT | 31366663 (*Toxoptera citricida*) |
| AG001 | 624 | AAAGCATGGATGTTGGACAAATTGGG | 60311985 (*Papilio dardanus*) |
| AG001 | 625 | AAAGCATGGATGTTGGACAAATTGGGGGTGT | 37951951 (*Ips pini*)<br>109195107 (*Myzus persicae*) |
| AG001 | 626 | AAATACAAATTGTGCAAAGTCCG | 25958703 (*Curculio glandium*) |
| AG001 | 627 | AACTTGTGCATGATCACCGGAG | 22039624 (*Ctenocephalides felis*) |
| AG001 | 628 | AAGCATGGATGTTGGACAAATTGGGG | 112433559 (*Myzus persicae*) |
| AG001 | 629 | AAGCATGGATGTTGGACAAATTGGGGGTGTGTT | 70909486 (*Mycetophagus quadripustulatus*) |
| AG001 | 630 | ACTGGTGAATTCTTCCGTTTGAT | 77327303 (*Chironomus tentans*) |
| AG001 | 631 | ATTGAAAAAACTGGTGAATTCTTCCGTTTGATCTATGATGTTAA | 22039624 (*Ctenocephalides felis*) |
| AG001 | 632 | CCAAAGCATGGATGTTGGACAA | 90138164 (*Spodoptera frugiperda*) |
| AG001 | 633 | CCCAAAGCATGGATGTTGGACAA | 48927129 (*Hydropsyche sp.*)<br>76551269 (*Spodoptera frugiperda*) |
| AG001 | 634 | CCCAAAGCATGGATGTTGGACAAA | 91835558 (*Bombyx mori*)<br>103783745 (*Heliconius erato*)<br>101419954 (*Plodia interpunctella*) |
| AG001 | 635 | CCCAAAGCATGGATGTTGGACAAATT | 73619372 (*Aphis gossypii*)<br>77329254 (*Chironomus tentans*) |
| AG001 | 636 | CCCAAAGCATGGATGTTGGACAAATTGGG | 22474232 (*Helicoverpa armigera*) |
| AG001 | 637 | CCCAAAGCATGGATGTTGGACAAATTGGGGG | 84647382 (*Myzus persicae*) |
| AG001 | 638 | CCCAAAGCATGGATGTTGGACAAATTGGGGGTGT | 84647995 (*Myzus persicae*) |
| AG001 | 639 | CCCAAAGCATGGATGTTGGACAAATTGGGGGTGTGTT | 60305420 (*Mycetophagus quadripustulatus*) |
| AG001 | 640 | CTGGATTCATGGATGTGATCA | 27617172 (*Anopheles gambiae*) |
| AG001 | 641 | GAATTCTTCCGTTTGATCTATGATGT | 50565112 (*Homalodisca coagulata*)<br>71049326 (*Oncometopia nigricans*) |
| AG001 | 642 | GCATGGATGTTGGACAAATTGGG | 92969396 (*Drosophila grimshawi*)<br>93001617 (*Drosophila mojavensis*)<br>92929731 (*Drosophila virilis*) |
| AG001 | 643 | GCATGGATGTTGGACAAATTGGGG | 67885868 (*Drosophila pseudoobscura*) |
| AG001 | 644 | GCATGGATGTTGGACAAATTGGGGGTGT | 90814901 (*Nasonia vitripennis*) |
| AG001 | 645 | GCATGGATGTTGGACAAATTGGGGGTGTGTTCGCCCC | 25956479 (*Biphyllus lunatus*) |
| AG001 | 646 | GCCCCAAAGCATGGATGTTGGACAA | 50565112 (*Homalodisca coagulata*) |
| AG001 | 647 | GCTGGATTCATGGATGTGATC | 103775903 (*Heliconius erato*) |
| AG001 | 648 | GGATCATTCGATATTGTCCACAT | 113017118 (*Bemisia tabaci*) |
| AG001 | 649 | GGCAACTTGTGCATGATCACCGGAGG | 25958703 (*Curculio glandium*) |
| AG001 | 650 | TACAAATTGTGCAAAGTCCGCAA | 56161193 (*Rhynchosciara americana*) |
| AG001 | 651 | TATCCTGCTGGATTCATGGATGT | 40934103 (*Bombyx mori*) |
| AG001 | 652 | TCACCATTGAAAAAACTGGTGAATTCTTC | 62083410 (*Lysiphlebus testaceipes*) |
| AG001 | 653 | TGCATGATCACCGGAGGCAGGAA | 3478550 (*Antheraea yamamai*) |

TABLE 4-AG-continued

| Target ID | SEQ ID NO | Sequence * | Example Gi-number and species |
|---|---|---|---|
| AG001 | 654 | TGCATGATCACCGGAGGCAGGAATTTGGG | 14627585 (*Drosophila melanogaster*) <br> 33355008 (*Drosophila yakuba*) |
| AG001 | 655 | TGGATGTTGGACAAATTGGGGGTGT | 90814560 (*Nasonia vitripennis*) |
| AG001 | 656 | TGTGCATGATCACCGGAGGCAG | 92949859 (*Drosophila ananassae*) <br> 92999306 (*Drosophila grimshawi*) |
| AG001 | 657 | TGTGCATGATCACCGGAGGCAGGAATTTGGG | 67842487 (*Drosophila pseudoobscura*) |
| AG005 | 658 | AAGATCGACAGGCATCTGTACCACG | 83935651 (*Lutzomyia longipalpis*) |
| AG005 | 659 | AAGATCGACAGGCATCTGTACCACGCCCTGTACATGAAGGC | 76552995 (*Spodoptera frugiperda*) |
| AG005 | 660 | AAGGGTAACGTGTTCAAGAACAA | 18932248 (*Anopheles gambiae*) <br> 60306606 (*Sphaerius sp.*) |
| AG005 | 661 | AAGGGTAACGTGTTCAAGAACAAG | 18953735 (*Anopheles gambiae*) <br> 25957811 (*Cicindela campestris*) <br> 60311920 (*Euclidia glyphica*) |
| AG005 | 662 | AAGGGTAACGTGTTCAAGAACAAGAGAGT | 25958948 (*Curculio glandium*) <br> 90812513 (*Nasonia giraulti*) |
| AG005 | 663 | ACAAGAAGAAGGCTGAGAAGGC | 60311700 (*Euclidia glyphica*) |
| AG005 | 664 | ATCAAGGATGGTTTGATCATTAA | 25957811 (*Cicindela campestris*) |
| AG005 | 665 | ATGGAATACATCCACAAGAAGAAG | 56149737 (*Rhynchosciara americana*) |
| AG005 | 666 | CAAAACATCCGTAAATTGATCAAGGATGGT | 60314333 (*Panorpa cf. vulgaris APV-2005*) |
| AG005 | 667 | CAAAACATCCGTAAATTGATCAAGGATGGTTTGATCAT | 25958948 (*Curculio glandium*) |
| AG005 | 668 | CAAGGGTAACGTGTTCAAGAA | 476608 (*Drosophila melanogaster*) <br> 38048300 (*Drosophila yakuba*) |
| AG005 | 669 | CAAGGGTAACGTGTTCAAGAACAAG | 92946023 (*Drosophila ananassae*) <br> 2871633 (*Drosophila melanogaster*) <br> 68267374 (*Drosophila simulans*) <br> 33354497 (*Drosophila yakuba*) <br> 83937096 (*Lutzomyia longipalpis*) |
| AG005 | 670 | CATCTGTACCACGCCCTGTACATGAAGGC | 101417042 (*Plodia interpunctella*) |
| AG005 | 671 | GAAGAAGGCTGAGAAGGCCCG | 40874303 (*Bombyx mori*) |
| AG005 | 672 | GACAGGCATCTGTACCACGCCCTGTACATGAAGGC | 90135865 (*Bicyclus anynana*) |
| AG005 | 673 | GAGAAGGCCCGTGCCAAGATGTTG | 82572137 (*Acyrthosiphon pisum*) |
| AG005 | 674 | GATCCAAATGAAATCAATGAGATTGC | 60312128 (*Papilio dardanus*) |
| AG005 | 675 | GCTCGTATGCCTCAAAAGGAACTATGG | 25957246 (*Carabus granulatus*) |
| AG005 | 676 | GGGTAACGTGTTCAAGAACAAG | 4447348 (*Drosophila melanogaster*) |
| AG005 | 677 | GGTAACGTGTTCAAGAACAAG | 18948649 (*Anopheles gambiae*) |
| AG005 | 678 | TACATCCACAAGAAGAAGGCTGAGAAG | 2871633 (*Drosophila melanogaster*) |
| AG005 | 679 | TACCACGCCCTGTACATGAAGGC | 10764114 (*Manduca sexta*) |
| AG005 | 680 | TCAATGAGATTGCCAACACCAACTC | 83935651 (*Lutzomyia longipalpis*) |
| AG005 | 681 | TGATCAAGGATGGTTTGATCAT | 77642775 (*Aedes aegypti*) <br> 27615052 (*Anopheles gambiae*) <br> 92982271 (*Drosophila grimshawi*) <br> 67896961 (*Drosophila pseudoobscura*) |
| AG005 | 682 | TGATCAAGGATGGTTTGATCATTAAGAA | 92042883 (*Drosophila willistoni*) |
| AG005 | 683 | TGGTTGGATCCAAATGAAATCA | 40867709 (*Bombyx mori*) <br> 101417042 (*Plodia interpunctella*) |
| AG005 | 684 | TGGTTGGATCCAAATGAAATCAA | 15355452 (*Apis mellifera*) <br> 83662749 (*Myzus persicae*) |

TABLE 4-AG-continued

| Target ID | SEQ ID NO | Sequence * | Example Gi-number and species |
|---|---|---|---|
| AG005 | 685 | TGGTTGGATCCAAATGAAATCAATGAGAT | 63013469 (Bombyx mori)<br>55908261 (Locusta migratoria) |
| AG005 | 686 | TGTACCACGCCCTGTACATGAAGGC | 23573622 (Spodoptera frugiperda) |
| AG005 | 687 | TTGATCAAGGATGGTTTGATCA | 113019292 (Bemisia tabaci) |
| AG005 | 688 | TTGATCAAGGATGGTTTGATCAT | 61674956 (Aedes aegypti)<br>41576849 (Culicoides sonorensis) |
| AG005 | 689 | TTGATGGAATACATCCACAAGAAGAAGGC | 92225847 (Drosophila willistoni) |
| AG005 | 690 | AGGATGCGTGTCTTGAGGCGTCT | 110887217 (Argas monolakensis) |
| AG005 | 691 | AAGGCCAAGGGTAACGTGTTCAAGAACAAG | 110887217 (Argas monolakensis) |
| AG010 | 692 | CGTTTGTGTCAAAAGTTTGGAGAATA | 78539702 (Glossina morsitans) |
| AG010 | 693 | GATGTTTTAAGATGGGTCGATCG | 110759793 (Apis mellifera) |
| AG010 | 694 | TTTTACAGGCATATGCTTATGAGGGAAGATTT | 55902158 (Locusta migratoria) |
| AG010 | 695 | TTTTTCGAGGTGGTCAATCAGCATTCGGC | 92925934 (Drosophila virilis) |
| AG014 | 696 | AACATGCTGAACCAAGCCCGT | 75466802 (Tribolium castaneum) |
| AG014 | 697 | AACATGCTGAACCAAGCCCGTCT | 87266590 (Choristoneura fumiferana)<br>103779114 (Heliconius erato) |
| AG014 | 698 | AAGATCATGGAATACTATGAGAAGAA | 101403826 (Plodia interpunctella) |
| AG014 | 699 | AAGATCATGGAATACTATGAGAAGAAGGAGAA | 81520950 (Lutzomyia longipalpis) |
| AG014 | 700 | AATGAAAAGGCCGAGGAAATTGATGC | 62239529 (Diabrotica virgifera) |
| AG014 | 701 | ATGGAATACTATGAGAAGAAGGA | 16901350 (Ctenocephalides felis) |
| AG014 | 702 | CAATCCTCCAACATGCTGAACCA | 53148472 (Plutella xylostella) |
| AG014 | 703 | CAGATCAAGCATATGATGGCCTTCAT | 53148472 (Plutella xylostella) |
| AG014 | 704 | GCAGATCAAGCATATGATGGCCTTCAT | 87266590 (Choristoneura fumiferana)<br>9732 (Manduca sexta)<br>90814338 (Nasonia vitripennis) |
| AG014 | 705 | GCGGAAGAAGAATTTAACATTGAAAAGGG | 50558386 (Homalodisca coagulata)<br>71552170 (Oncometopia nigricans) |
| AG016 | 706 | AACGACGACATCACCCATCCTATTC | 110248186 (Spodoptera frugiperda)<br>27372076 (Spodoptera littoralis) |
| AG016 | 707 | AACGGTTCCATGGAGAACGTGTG | 2921501 (Culex pipiens)<br>92950254 (Drosophila ananassae)<br>110240379 (Spodoptera frugiperda) |
| AG016 | 708 | AACGGTTCCATGGAGAACGTGTGTCT | 24646342 (Drosophila melanogaster) |
| AG016 | 709 | AACGGTTCCATGGAGAACGTGTGTCTTCTTGAA | 91829127 (Bombyx mori) |
| AG016 | 710 | ATGATCCAGACCGGTATCTCCGC | 22474040 (Helicoverpa armigera) |
| AG016 | 711 | ATGCCGAACGACGACATCACCCATCC | 31206154 (Anopheles gambiae str. PEST) |
| AG016 | 712 | CAATGCGAGAAACACGTGCTGGT | 9713 (Manduca sexta) |
| AG016 | 713 | CCGCACAACGAAATCGCCGCCCAAAT | 75469507 (Tribolium castaneum) |
| AG016 | 714 | CGTTTCTTCAAGCAGGACTTCGA | 83937868 (Lutzomyia longipalpis) |
| AG016 | 715 | CTTGGACATCCAAGGTCAACCCATCAACCCATGGTC | 104530890 (Belgica antarctica) |
| AG016 | 716 | GAAATGATCCAGACCGGTATCTC | 2921501 (Culex pipiens)<br>92966144 (Drosophila grimshawi) |
| AG016 | 717 | GAAATGATCCAGACCGGTATCTCCGCCATCGACGTGATGAACTC | 31206154 (Anopheles gambiae str. PEST) |

TABLE 4-AG-continued

| Target ID | SEQ ID NO | Sequence * | Example Gi-number and species |
|---|---|---|---|
| AG016 | 718 | GAAGAAATGATCCAGACCGGTAT | 75469507 (*Tribolium castaneum*) |
| AG016 | 719 | GAAGAAGTACCCGGACGTCGTGG | 22038926 (*Ctenocephalides felis*) |
| AG016 | 720 | GACATCCAAGGTCAACCCATCAA | 16898595 (*Ctenocephalides felis*) |
| AG016 | 721 | GCCCGTTTCTTCAAGCAGGACTTCGA | 31206154 (*Anopheles gambiae* str. PEST) |
| AG016 | 722 | GCCGCCCAAATCTGTAGACAGGC | 60295607 (*Homalodisca coagulata*) |
| AG016 | 723 | GGATCAGGAAAACCCATTGACAAAGGTCC | 49395165 (*Drosophila melanogaster*)<br>99009492 (*Leptinotarsa decemlineata*) |
| AG016 | 724 | GGTTACATGTACACCGATTTGGC | 91829127 (*Bombyx mori*) |
| AG016 | 725 | GGTTACATGTACACCGATTTGGCCACCAT | 77750765 (*Aedes aegypti*)<br>9713 (*Manduca sexta*)<br>110248186 (*Spodoptera frugiperda*)<br>27372076 (*Spodoptera littoralis*) |
| AG016 | 726 | GGTTACATGTACACCGATTTGGCCACCATTTACGAA | 92231646 (*Drosophila willistoni*) |
| AG016 | 727 | GTGTCGGAGGATATGTTGGGCCG | 92460250 (*Drosophila erecta*)<br>24646342 (*Drosophila melanogaster*)<br>55694673 (*Drosophila yakuba*) |
| AG016 | 728 | TACATGTACACCGATTTGGCCACCAT | 31206154 (*Anopheles gambiae* str. PEST) |
| AG016 | 729 | TTCAACGGATCAGGAAAACCCATTGACAAGGTCC | 99010653 (*Leptinotarsa decemlineata*) |
| AG016 | 730 | TTCCCCGGTTACATGTACACCGATTTGGCCAC | 2921501 (*Culex pipiens*)<br>75710699 (*Tribolium castaneum*) |
| AG016 | 731 | TTCCCCGGTTACATGTACACCGATTTGGCCACCAT | 62239897 (*Diabrotica virgifera*)<br>92957249 (*Drosophila ananassae*)<br>92477149 (*Drosophila erecta*)<br>67896654 (*Drosophila pseudoobscura*) |
| AG016 | 732 | TTCCCCGGTTACATGTACACCGATTTGGCCACCATTTA | 92969578 (*Drosophila grimshawi*) |
| AG016 | 733 | TTCCCCGGTTACATGTACACCGATTTGGCCACCATTTACGA | 103744758 (*Drosophila melanogaster*) |
| AG016 | 734 | TTCGCCATCGTGTTCGCCGCCATGGGTGT | 31206154 (*Anopheles gambiae* str. PEST) |
| AG016 | 735 | TTCTTCAAGCAGGACTTCGAAGA | 9713 (*Manduca sexta*) |
| AG016 | 736 | TTCTTGAATTTGGCCAACGATCC | 92972277 (*Drosophila grimshawi*)<br>99011193 (*Leptinotarsa decemlineata*) |
| AG016 | 737 | TTCTTGAATTTGGCCAACGATCCCACCATCGAG | 67839381 (*Drosophila pseudoobscura*) |
| AG016 | 738 | GCCGAATTTTTGGCTTATCAATG | 84116133 (*Dermatophagoides farinae*) |

TABLE 4-TC

| Target ID | SEQ ID NO | Sequence * | Example Gi-number and species |
|---|---|---|---|
| TC001 | 813 | AAAGCATGGATGTTGGATAAA | 70909480 (*Carabus granulatus*)<br>16898765 (*Ctenocephalides felis*)<br>60298000 (*Diaprepes abbreviatus*) |
| TC001 | 814 | AATTTGTGTATGATTACTGGAGG | 55904576 (*Locusta migratoria*) |
| TC001 | 815 | ACTGGAGGTCGTAACTTGGGCGTGT | 60298000 (*Diaprepes abbreviatus*) |
| TC001 | 816 | ATGATTACTGGAGGTCGTAACTTGGGGCGTGT | 73619372 (*Aphis gossypii*)<br>37804548 (*Rhopalosiphum padi*) |
| TC001 | 817 | ATGCAAAGATTGATTAAAGTTGACGG | 70909478 (*Biphyllus lunatus*) |
| TC001 | 818 | ATTAAAGTTGACGGAAAAGTT | 110763874 (*Apis mellifera*) |

TABLE 4-TC-continued

| Target ID | SEQ ID NO | Sequence * | Example Gi-number and species |
|---|---|---|---|
| TC001 | 819 | ATTGAGAAAACTGGGGAATTCTTCCG | 37952206 (*Ips pini*) |
| TC001 | 820 | ATTGTTATGCAAAGATTGATTAAAGTTGACGGAAAAGT | 70909486 (*Mycetophagus quadripustulatus*) |
| TC001 | 821 | CCAAGAAGCATTTGAAGCGTCT | 55904580 (*Locusta migratoria*) |
| TC001 | 822 | CCAAGAAGCATTTGAAGCGTCTC | 83935971 (*Lutzomyia longipalpis*) |
| TC001 | 823 | GCGCCCAAAGCATGGATGTTGGA | 103790417 (*Heliconius erato*) 101419954 (*Plodia interpunctella*) |
| TC001 | 824 | GGCCCCAAGAAGCATTTGAAGCGT | 14700642 (*Drosophila melanogaster*) |
| TC001 | 825 | TGATTACTGGAGGTCGTAACTTGGGGCGTGT | 73612212 (*Aphis gossypii*) |
| TC001 | 826 | TGTATGATTACTGGAGGTCGTAACTTGGGGCGTGT | 70909478 (*Biphyllus lunatus*) |
| TC001 | 827 | TTGATTTATGATGTTAAGGGA | 77325485 (*Chironomus tentans*) |
| TC001 | 828 | TTGTGTATGATTACTGGAGGTCGTAA | 60305816 (*Mycetophagus quadripustulatus*) |
| TC002 | 829 | AAAAACAAACGAGCGGCCATCCAGGC | 18920284 (*Anopheles gambiae*) |
| TC002 | 830 | ATCGACCAAGAGATCCTCACAGCGAAGAAAAACGCGTCGAAA AACAAACGAGCGGCCATCCAGGCC | 75717966 (*Tribolium castaneum*) |
| TC002 | 831 | CTCCAGCAGATCGATGGCACCCT | 92475657 (*Drosophila erecta*) 13763220 (*Drosophila melanogaster*) |
| TC002 | 832 | TCAAGAGGAAGAAACGCTACGAAAAGCAGCTCCAGCAGATC GATGGCACCCTCAGCACCATCGAGATGCAGCGGGAGGCCCT CGAGGGGGCCAACACCAACACAGCCGTACTCAAAACGATGA AAAACGCAGCGGACGCCCTCAAAAATGCCCACCTCAACATG GATGTTGATGAGGT | 75717966 (*Tribolium castaneum*) |
| TC010 | 833 | AACCTCAAGTACCAGGACATGCCCGA | 90973566 (*Aedes aegypti*) |
| TC010 | 834 | AGCCGATTTTGTACAGTTATA | 92944620 (*Drosophila ananassae*) |
| TC010 | 835 | ATGGACACATTTTTCCAAATT | 33427937 (*Glossina morsitans*) |
| TC010 | 836 | ATGGACACATTTTTCCAAATTTTGATTTTCCACGG | 56151768 (*Rhynchosciara americana*) |
| TC010 | 837 | CAAGTACCAGGACATGCCCGA | 18911059 (*Anopheles gambiae*) |
| TC010 | 838 | CACATGCTGATGCGGGAGGACCTC | 67893321 (*Drosophila pseudoobscura*) |
| TC010 | 839 | CCTCAAGTACCAGGACATGCCCGA | 67893324 (*Drosophila pseudoobscura*) |
| TC010 | 840 | TCAAGTACCAGGACATGCCCGA | 67893321 (*Drosophila pseudoobscura*) |
| TC010 | 841 | TTCATGTACCATTTGCGCCGCTC | 92952825 (*Drosophila ananassae*) |
| TC014 | 842 | AAAATTCAGTCGTCAAACATGCTGAA | 76169390 (*Diploptera punctata*) |
| TC014 | 843 | AACATGCTGAACCAAGCCCGT | 87266590 (*Choristoneura fumiferana*) 103779114 (*Heliconius erato*) |
| TC014 | 844 | CACAGCAACTTGTGCCAGAAAT | 92923718 (*Drosophila virilis*) |
| TC014 | 845 | GAGAAAGCCGAAGAAATCGATGC | 77325830 (*Chironomus tentans*) |
| TC014 | 846 | GCCCGCAAACGTCTGGGCGAA | 92232132 (*Drosophila willistoni*) |
| TC014 | 847 | TAAAAGTGCGTGAAGACCACGT | 58371699 (*Lonomia obliqua*) |
| TC015 | 848 | ACACTGATGGACGGCATGAAGAA | 78531609 (*Glossina morsitans*) |
| TC015 | 849 | ATCGGCGGTTGTCGCAAACAACT | 6904417 (*Bombyx mori*) |
| TC015 | 850 | CCCGATGAGAAGATCCGGATGAA | 83922984 (*Lutzomyia longipalpis*) |
| TC015 | 851 | CTGCCCCGATGAGAAGATCCG | 92948836 (*Drosophila ananassae*) |
| TC015 | 852 | AACGAAACCGGTGCTTTCTTCTT | 84116975 (*Dermatophagoides farinae*) |

TABLE 4-MP

| Target ID | SEQ ID NO | Sequence * | Example Gi-number and species |
|---|---|---|---|
| MP001 | 908 | AAAGCATGGATGTTGGACAAA | 98994282 (Antheraea mylitta)<br>108789768 (Bombyx mori)<br>109978109 (Gryllus pennsylvanicus)<br>55904580 (Locusta migratoria) |
| MP001 | 909 | AAAGCATGGATGTTGGACAAAT | 77325485 (Chironomus tentans)<br>37951951 (Ips pini)<br>60311985 (Papilio dardanus)<br>30031258 (Toxoptera citricida) |
| MP001 | 910 | AAGAAGCATTTGAAGCGTTTAAACGCACC | 3658572 (Manduca sexta) |
| MP001 | 911 | AAGCATTTGAAGCGTTTAAACGC | 103790417 (Heliconius erato)<br>22474232 (Helicoverpa armigera) |
| MP001 | 912 | AAGCATTTGAAGCGTTTAAACGCACC | 25957217 (Carabus granulatus) |
| MP001 | 913 | AAGTCCGTACCGACCCTAATTATCCAGC | 46994131 (Acyrthosiphon pisum) |
| MP001 | 914 | ACGCACCCAAAGCATGGATGTT | 46999037 (Acyrthosiphon pisum) |
| MP001 | 915 | ACTATTAGATACGATATTGCA | 46998791 (Acyrthosiphon pisum) |
| MP001 | 916 | ACTGGACCCAAAGGTGTGCCATTTTTAACTACTCATGATGGCCGTACTAT | 46997137 (Acyrthosiphon pisum) |
| MP001 | 917 | AGAAGCATTTGAAGCGTTTAAA | 27620566 (Anopheles gambiae) |
| MP001 | 918 | AGAAGCATTTGAAGCGTTTAAACGCACC | 98994282 (Antheraea mylitta) |
| MP001 | 919 | AGAAGCATTTGAAGCGTTTAAACGCACCCAAAGCATGGATGTTGGACAAAT | 73619191 (Aphis gossypii) |
| MP001 | 920 | AGTAAGGGAGTTAAATTGACTA | 46998791 (Acyrthosiphon pisum) |
| MP001 | 921 | ATACAAGTTGTGTAAAGTAAAG | 29553519 (Bombyx mori) |
| MP001 | 922 | ATGGATGTTATATCTATCCAAAAGACCAGTGAGCACTTTAGATTGATCTATGATGTGAAAGGTCGTTTCAC | 46998791 (Acyrthosiphon pisum) |
| MP001 | 923 | ATTGATCTATGATGTGAAAGGTCGTTTCAC | 46999037 (Acyrthosiphon pisum) |
| MP001 | 924 | CAAAAGACCAGTGAGCACTTTAGATTGAT | 30031258 (Toxoptera citricida) |
| MP001 | 925 | CACAGAATTACTCCTGAAGAAGC | 73619191 (Aphis gossypii) |
| MP001 | 926 | CACAGAATTACTCCTGAAGAAGCAAAATACAAG | 46998791 (Acyrthosiphon pisum)<br>30031258 (Toxoptera citricida) |
| MP001 | 927 | CATCCAGGATCTTTTGATATTGTTCACATTAA | 31364848 (Toxoptera citricida) |
| MP001 | 928 | CATCCAGGATCTTTTGATATTGTTCACATTAAGGATGCAAATGAACATATTTTTGCTAC | 37804548 (Rhopalosiphum padi) |
| MP001 | 929 | CATCTAAAATTTTGGATCATATCCGTTTTGAAACTGGAAACTTGTGCATGAT | 46998791 (Acyrthosiphon pisum) |
| MP001 | 930 | CATTTGAAGCGTTTAAACGCACC | 30031258 (Toxoptera citricida) |
| MP001 | 931 | CATTTGAAGCGTTTAAACGCACCCAAAGCATGGATGTT | 46998791 (Acyrthosiphon pisum) |
| MP001 | 932 | CCAAAGCATGGATGTTGGACAA | 90138164 (Spodoptera frugiperda) |
| MP001 | 933 | CCAAGGAGTAAGGGAGTTAAATTGACTA | 73615238 (Aphis gossypii)<br>31364848 (Toxoptera citricida) |
| MP001 | 934 | CCCAAAGCATGGATGTTGGAC | 108789768 (Bombyx mori) |
| MP001 | 935 | CCCAAAGCATGGATGTTGGACAA | 50565112 (Homalodisca coagulata)<br>48927129 (Hydropsyche sp.)<br>76551269 (Spodoptera frugiperda) |
| MP001 | 936 | CCCAAAGCATGGATGTTGGACAAA | 56085210 (Bombyx mori)<br>103792451 (Heliconius erato)<br>101419954 (Plodia interpunctella) |

TABLE 4-MP-continued

| Target ID | SEQ ID NO | Sequence * | Example Gi-number and species |
|---|---|---|---|
| MP001 | 937 | CCCAAAGCATGGATGTTGGACAAAT | 22474095 (*Helicoverpa armigera*) |
| MP001 | 938 | CGTCCAAGCACCGGTCCACACAAACT | 47537863 (*Acyrthosiphon pisum*) |
| MP001 | 939 | CTGGAAACTTGTGCATGATAACTGGAGG | 78524585 (*Glossina morsitans*) |
| MP001 | 940 | GAAAGACATCCAGGATCTTTTGATATTGTTCACATTAAGGATGCAAATGAACATATTTTTGCTACCCGGATGAACAATGTTTTTATTATTGGAAAAGGTCAAAAGAACTACATTTCTCTACCAAG | 46997137 (*Acyrthosiphon pisum*) |
| MP001 | 941 | GATCATATCCGTTTTGAAACTGGAAACTTGTGCATGAT | 73614725 (*Aphis gossypii*) |
| MP001 | 942 | GATGCAAATGAACATATTTTTGCTAC | 31364848 (*Toxoptera citricida*) |
| MP001 | 943 | GCACCCAAAGCATGGATGTTGGA | 70909486 (*Mycetophagus quadripustulatus*) |
| MP001 | 944 | GCACCCAAAGCATGGATGTTGGACAAAT | 77329254 (*Chironomus tentans*) 60305420 (*Mycetophagus quadripustulatus*) |
| MP001 | 945 | GGATCTTTTGATATTGTTCACAT | 60303405 (*Julodis onopordi*) |
| MP001 | 946 | GGATCTTTTGATATTGTTCACATTAAGGATGCAAATGAACATATTTTTGCTAC | 73619191 (*Aphis gossypii*) |
| MP001 | 947 | GGCCCCAAGAAGCATTTGAAGCGTTTAA | 14693528 (*Drosophila melanogaster*) |
| MP001 | 948 | GGGCGTGTTGGTATTGTTACCAACAG | 31365398 (*Toxoptera citricida*) |
| MP001 | 949 | GGGCGTGTTGGTATTGTTACCAACAGGGAAAG | 73612212 (*Aphis gossypii*) 37804548 (*Rhopalosiphum padi*) |
| MP001 | 950 | GGTACAAACTGGACCCAAAGG | 60297572 (*Diaprepes abbreviatus*) |
| MP001 | 951 | GTTTTTATTATTGGAAAAGGTCAAAAGAACTACATTTCTCT | 73619191 (*Aphis gossypii*) 31364848 (*Toxoptera citricida*) |
| MP001 | 952 | TGAAGTATGCACTTACTGGTGC | 73619191 (*Aphis gossypii*) |
| MP001 | 953 | TGTAAAGTAAAGAGGGTACAAACTGGACCCAAAGGTGT | 73619191 (*Aphis gossypii*) |
| MP001 | 954 | TGTGTAAAGTAAAGAGGGTACAAACTGGACCCAAAGGTGT | 30031258 (*Toxoptera citricida*) |
| MP001 | 955 | TTCTTGCGTAATCGTTTGAAGTATGCACTTACTGGTGCCGAAGTCACCAAGATTGTCATGCAAAGATTAATCAAGGTTGATGGCAAAGTCCGTACCGACCCTAATTATCCAGC | 46998791 (*Acyrthosiphon pisum*) |
| MP001 | 956 | TTGGAAAAGGTCAAAAGAACTACATTTCTCT | 73615060 (*Aphis gossypii*) |
| MP001 | 957 | TTGGATCATATCCGTTTTGAAACTGGAAACTTGTGCATGAT | 37804548 (*Rhopalosiphum padi*) |
| MP002 | 958 | AAAAAAAATGGTACAACTAATAAACGAGCTGCATTGCAAGC | 47537017 (*Acyrthosiphon pisum*) |
| MP002 | 959 | AAGAAACGGTACGAACAACAA | 15363283 (*Apis mellifera*) |
| MP002 | 960 | ACAAGAATTTTTAGAAAAAAAATTGAACAAGAAGTAGCGATAGC | 47537017 (*Acyrthosiphon pisum*) |
| MP002 | 961 | CAAATTGATGGTACCATGTTAACTATTGAACAACAGCG | 47537017 (*Acyrthosiphon pisum*) |
| MP002 | 962 | GAAGATGCGATACAAAAGCTTCGATCCAC | 47537017 (*Acyrthosiphon pisum*) |
| MP002 | 963 | GAGTTTCTTTAGTAAAGTATTCGGTGG | 110762684 (*Apis mellifera*) |
| MP010 | 964 | AAAAGATGATCCAAATAGTTT | 110759793 (*Apis mellifera*) |
| MP010 | 965 | AAAATATTATTGATGGACACATTTTTCCATATTTTGATATTCCA | 47520567 (*Acyrthosiphon pisum*) |
| MP010 | 966 | AATAGTCCTGATGAAACATCATATTATAG | 47520567 (*Acyrthosiphon pisum*) |
| MP010 | 967 | CAAAAGATGATCCAAATAGTTTCCGATTGCCAGAAAACTTCAGTTTATATCCACAGTTCATGTATCATTTAAGAAGGTCTCAATTTCTACAAGTTTTTAA | 47520567 (*Acyrthosiphon pisum*) |
| MP010 | 968 | CAACATTCCAGTGGCTATAAACGAAT | 47520567 (*Acyrthosiphon pisum*) |
| MP010 | 969 | CACATGTTGATGCGTGAAGATGTTAC | 47520567 (*Acyrthosiphon pisum*) |

TABLE 4-MP-continued

| Target ID | SEQ ID NO | Sequence * | Example Gi-number and species |
|---|---|---|---|
| MP010 | 970 | CCAATTCTGTATAGCTATAGTTTTAATGGTAGGCCAGAACCTGTACTTTTGGATACCAG | 47520567 (*Acyrthosiphon pisum*) |
| MP010 | 971 | CCATCTCAAACACATAATAATATGTATGCTTATGGAGG | 55814942 (*Acyrthosiphon pisum*) |
| MP010 | 972 | CTCAAAACTCGATTCCCAATGCCTCGGTATATTGACACAGAACAAGGTGGTAGTCAGGCAAGATTTTTACTATGCAAAGT | 55814942 (*Acyrthosiphon pisum*) |
| MP010 | 973 | GGTGATGGTGGAGCACCAGTTTTGACAGATGATGTAAGCTTGCA | 55814942 (*Acyrthosiphon pisum*) |
| MP010 | 974 | GTGGCTGCATACAGTTCATTACGCAGTA | 28571527 (*Drosophila melanogaster*) |
| MP010 | 975 | TAATGGCTCGTATGGTAGTGAACCGTGCTGAAACTGA | 47520567 (*Acyrthosiphon pisum*) |
| MP010 | 976 | TATAGGCACATGTTGATGCGTGAAGAT | 40924332 (*Bombyx mori*) |
| MP010 | 977 | TGGGCTGATCGTACGCTTATACGCTTGTGTCA | 47520567 (*Acyrthosiphon pisum*) |
| MP010 | 978 | TTAGCTAGGAATTGGGCAGACCCTGT | 47520567 (*Acyrthosiphon pisum*) |
| MP016 | 979 | AAACAAGATTTTGAGGAAAATGG | 35508791 (*Acyrthosiphon pisum*) |
| MP016 | 980 | AACCTGGTAAATCAGTTCTTGA | 35508791 (*Acyrthosiphon pisum*) |
| MP016 | 981 | AACGACGACATCACCCATCCTATTC | 110240379 (*Spodoptera frugiperda*) 27372076 (*Spodoptera littoralis*) |
| MP016 | 982 | AATTTAGCTAATGATCCTACTATTGA | 15366446 (*Apis mellifera*) |
| MP016 | 983 | ACTATGCCTAACGACGACATCACCCATCC | 237458 (*Heliothis virescens*) |
| MP016 | 984 | ATAGTATTTGCTGCTATGGGTGTTAATATGGAAAC | 30124460 (*Toxoptera citricida*) |
| MP016 | 985 | CAAATTTGTAGACAAGCTGGTCT | 103020368 (*Tribolium castaneum*) |
| MP016 | 986 | CATGAAGACAATTTTGCTATAGTATTTGCTGCTATGGGTGTTAATATGGAAAC | 35508791 (*Acyrthosiphon pisum*) |
| MP016 | 987 | CCGATAGATAAAGGACCTCCTATTTTGGCTGAAGATTATTTGGATATTGAAGGCCAACCTATTAATCCATA | 35508791 (*Acyrthosiphon pisum*) |
| MP016 | 988 | CCTATTTTGGCTGAAGATTAT | 55905051 (*Locusta migratoria*) |
| MP016 | 989 | CGTATCATTACACCACGTCTTGCTTTAACTGCTGCTGAATTTTTAGCTTA | 30124460 (*Toxoptera citricida*) |
| MP016 | 990 | CGTCTTGCTTTAACTGCTGCTGAATTTTTAGCTTA | 35508791 (*Acyrthosiphon pisum*) |
| MP016 | 991 | GAAGAAGTACCTGGGCGTCGTGGTTTCCCTGGTTACATGTACAC | 30124460 (*Toxoptera citricida*) |
| MP016 | 992 | GAAGGAAGAAATGGTTCTATCACACAAATACCTATTTTAACTATGCCTAA | 30124460 (*Toxoptera citricida*) |
| MP016 | 993 | GAAGGAAGAAATGGTTCTATCACACAAATACCTATTTTAACTATGCCTAACGA | 73615307 (*Aphis gossypii*) |
| MP016 | 994 | GATTTAGCTACAATTTATGAACG | 30124460 (*Toxoptera citricida*) |
| MP016 | 995 | GCCAGATTCTTTAAACAAGATTTTGAGGAAAATGG | 30124460 (*Toxoptera citricida*) |
| MP016 | 996 | GCTATGGGTGTTAATATGGAAAC | 75469507 (*Tribolium castaneum*) |
| MP016 | 997 | GCTGCAGGTTTACCACATAATGAGATTGCTGCTCAAATTTG | 35508791 (*Acyrthosiphon pisum*) |
| MP016 | 998 | GCTGGGCGTGTAGAAGGAAGAAATGGTTCTATCACACAAATACCTATTTTAACTATGCCTAACGA | 55813096 (*Acyrthosiphon pisum*) |
| MP016 | 999 | GGTTACATGTACACCGATTTAGCTACAATTTATGAACG | 55813096 (*Acyrthosiphon pisum*) 73615307 (*Aphis gossypii*) |
| MP016 | 1000 | GTGGACAAAAAATTCCAATATTTTC | 55813096 (*Acyrthosiphon pisum*) |

TABLE 4-MP-continued

| Target ID | SEQ ID NO | Sequence * | Example Gi-number and species |
|---|---|---|---|
| MP016 | 1001 | GTGTCGGAGGATATGTTGGGCCG | 92460250 (*Drosophila erecta*)<br>2286639 (*Drosophila melanogaster*)<br>55694673 (*Drosophila yakuba*) |
| MP016 | 1002 | GTTCTTGAATTTAGCTAATGATCCTACTATTGA | 82563007 (*Acyrthosiphon pisum*) |
| MP016 | 1003 | TCAATGGAGAATGTTTGTTTGTTCTTGAATTTAGCTAATGATCCTACTATTGA | 35508791 (*Acyrthosiphon pisum*)<br>30124460 (*Toxoptera citricida*) |
| MP016 | 1004 | TCAGCTATTGATATCATGAACTCTATTGCTCGTGGACAAAAAATTCCAATATTTTC | 35508791 (*Acyrthosiphon pisum*) |
| MP016 | 1005 | TCATATGCTGAAGCTTTAAGAGAAGTTTCTGCTGCTCG | 30124460 (*Toxoptera citricida*) |
| MP016 | 1006 | TCCAGAACATATCCTCAAGAAATGATTCAAACTGGTAT | 35508791 (*Acyrthosiphon pisum*) |
| MP016 | 1007 | TCTATTGCTCGTGGACAAAAAATTCC | 110764393 (*Apis mellifera*) |
| MP016 | 1008 | TGTGAAAAGCATGTCTTAGTTATTTTAACTGACATGAGTTCATATGCTGAAGCTTTAAGAGAAGTTTCTGCTGCTCGTGAAGAAGTACCTGGGCGTCGTGGTTTCCC | 55813096 (*Acyrthosiphon pisum*) |
| MP016 | 1009 | TTAACTGACATGAGTTCATATGCTGAAGCTTTAAGAGAAGTTTCTGCTGCTCGTGAAGAAGTACCTGG | 73615307 (*Aphis gossypii*) |
| MP027 | 1010 | TTTTTAAAAATTTTAAAGAAAAAA | 47522167 (*Acyrthosiphon pisum*) |

TABLE 4-NL

| Target ID | SEQ ID NO | Sequence * | Example Gi-number and species |
|---|---|---|---|
| NL001 | 1161 | CTGAAGAAGCTAAGTACAAGCT | 16566724 (*Spodoptera frugiperda*) |
| NL001 | 1162 | TTCTTCCGTTTGATCTATGATGTTAA | 16900870 (*Ctenocephalides felis*) |
| NL001 | 1163 | CAGCTGAAGAAGCTAAGTACAA | 16900870 (*Ctenocephalides felis*), 56199521 (*Culicoides sonorensis*) |
| NL001 | 1164 | GAGTTCTTCCGTTTGATCTATGATGTTAA | 16900945 (*Ctenocephalides felis*) |
| NL001 | 1165 | AAGTACAAGCTGTGCAAAGTGAAG | 22474232 (*Helicoverpa armigera*) |
| NL001 | 1166 | TTCGACATCGTGCACATCAAGGAC | 22474232 (*Helicoverpa armigera*) |
| NL001 | 1167 | ATCACAGCTGAAGAAGCTAAGTACAAG | 25956820 (*Biphyllus lunatus*) |
| NL001 | 1168 | TGTGTATGATCACTGGAGGTCGTAA | 25957367 (*Carabus granulatus*) |
| NL001 | 1169 | AACGTTTTCATCATCGGCAAG | 27613698 (*Anopheles gambiae*) |
| NL001 | 1170 | CCAAAATCATGGACTTCATCA | 3738704 (*Manduca sexta*) |
| NL001 | 1171 | TGATCTATGATGTTAAGGGACG | 3738704 (*Manduca sexta*) |
| NL001 | 1172 | CATGGATGTTGGACAAATTGGG | 37951951 (*Ips pini*), 56772312 (*Drosophila virilis*), 60305420 (*Mycetophagus quadripustulatus*), 67885868 (*Drosophila pseudoobscura*), 77321575 (*Chironomus tentans*), 25956479 (*Biphyllus lunatus*), 22474232 (*Helicoverpa armigera*); |
| NL001 | 1173 | TTTTGCCACTAGGTTGAACAACGT | 37953169 (*Ips pini*) |
| NL001 | 1174 | GCAGCGTCTCATCAAGGTTGACGGCAA | 48927129 (*Hydropsyche sp.*) |
| NL001 | 1175 | AAGGGACGTTTCACCATCCAC | 50818668 (*Heliconius melpomene*) |
| NL001 | 1176 | AACCTGTGTATGATCACTGGAGG | 60293875 (*Homalodisca coagulata*) |
| NL001 | 1177 | ACTAACTGTGAAGTGAAGAAAATTGT | 60293875 (*Homalodisca coagulata*) |

TABLE 4-NL-continued

| Target ID | SEQ ID NO | Sequence * | Example Gi-number and species |
|---|---|---|---|
| NL001 | 1178 | TTCTTCCGTTTGATCTATGATGT | 60293875 (*Homalodisca coagulata*), 71047771 (*Oncometopia nigricans*) |
| NL001 | 1179 | TGTATGATCACTGGAGGTCGTAACTTGGG | 60297219 (*Diaprepes abbreviatus*) |
| NL001 | 1180 | CATGGATGTTGGACAAATTGGGTGG | 60311985 (*Papilio dardanus*) |
| NL001 | 1181 | GCTGAAGAAGCTAAGTACAAG | 68758383 (*Acanthoscurria gomesiana*) |
| NL001 | 1182 | GGAGGTCGTAACTTGGGTCGTGT | 77327303 (*Chironomus tentans*) |
| NL001 | 1183 | TATGATGTTAAGGGACGTTTCACCAT | 77327303 (*Chironomus tentans*) |
| NL001 | 1184 | CATGGATGTTGGACAAATTGGG | 93002561 (*Drosophila grimshawi*) 93001617 (*Drosophila mojavensis*) 92939328 (*Drosophila virilis*) 112433559 (*Myzus persicae*) 90814922 (*Nasonia vitripennis*) |
| NL001 | 1185 | CTGAAGAAGCTAAGTACAAGCT | 110264122 (*Spodoptera frugiperda*) |
| NL001 | 1186 | GAAGAAGCTAAGTACAAGCTGTG | 90820001 (*Graphocephala atropunctata*) |
| NL001 | 1187 | TTGCACAGCTTGTACTTAGCTTCTTC | 90134075 (*Bicyclus anynana*) |
| NL001 | 1188 | AAGTACAAGCTGTGCAAAGTGAAG | 112350104 (*Helicoverpa armigera*) |
| NL001 | 1189 | ATGATCACTGGAGGTCGTAACTTGGGTCG | 113017118 (*Bemisia tabaci*) |
| NL001 | 1190 | GGTCGTAACTTGGGTCGTGTGGG | 109978109 (*Gryllus pennsylvanicus*) |
| NL001 | 1191 | TTCGACATCGTGCACATCAAGGAC | 112350104 (*Helicoverpa armigera*) |
| NL001 | 1192 | ACATCGTGCACATCAAGGACG | 90981811 (*Aedes aegypti*) |
| NL003 | 1193 | CAGGAGTTGAAGATCATCGGAGAGTATGG | 15457393 (*Drosophila melanogaster*), 76551770 (*Spodoptera frugiperda*) |
| NL003 | 1194 | CGTAAGGCCGCTCGTGAGCTG | 1797555 (*Drosophila melanogaster*) |
| NL003 | 1195 | AAGGTAACGCCCTGCTGCGTCG | 18863433 (*Anopheles gambiae*) |
| NL003 | 1196 | CAGGAGTTGAAGATCATCGGAGAGTA | 2459311 (*Antheraea yamamai*), 49532931 (*Plutella xylostella*) |
| NL003 | 1197 | GCCAAGTCCATCCATCACGCCCG | 33354488 (*Drosophila yakuba*), 60312414 (*Papilio dardanus*) |
| NL003 | 1198 | AAGTCCATCCATCACGCCCGT | 33528372 (*Trichoplusia ni*) |
| NL003 | 1199 | TGTTTGAAGGTAACGCCCTGCT | 34788046 (*Callosobruchus maculatus*) |
| NL003 | 1200 | CAGGAGTTGAAGATCATCGGAGA | 35505798 (*Acyrthosiphon pisum*), 56772256 (*Drosophila virilis*) |
| NL003 | 1201 | GTGCGCCTGGACTCGCAGAAGCACAT | 38624772 (*Drosophila melanogaster*) |
| NL003 | 1202 | GAGTTGAAGATCATCGGAGAGTA | 4158332 (*Bombyx mori*) |
| NL003 | 1203 | TTGGGTTTAAAAATTGAAGATTTC | 56150446 (*Rhynchosciara americana*) |
| NL003 | 1204 | TCGCAGAAGCACATTGACTTCTC | 56772256 (*Drosophila virilis*) |
| NL003 | 1205 | AGAATGAAGCTCGATTACGTC | 60306665 (*Sphaerius* sp.) |
| NL003 | 1206 | TTTGTGGTGCGCCTGGACTCG | 60312414 (*Papilio dardanus*) |
| NL003 | 1207 | AGAAGCACATTGACTTCTCGCTGAAGTC | 63514675 (*Ixodes scapularis*) |
| NL003 | 1208 | TCGCAGAAGCACATTGACTTCTCGCT | 70979521 (*Anopheles albimanus*) |
| NL003 | 1209 | CTCATCAGACAAAGACATATCAGAGT | 71536734 (*Diaphorina citri*) |
| NL003 | 1210 | TTGAAGATCATCGGAGAGTATGG | 73612958 (*Aphis gossypii*) |
| NL003 | 1211 | AAAATTGAAGATTTCCTTGAA | 75467497 (*Tribolium castaneum*) |

TABLE 4-NL-continued

| Target ID | SEQ ID NO | Sequence * | Example Gi-number and species |
|---|---|---|---|
| NL003 | 1212 | CAGAAGCACATTGACTTCTCGCT | 77730066 (*Aedes aegypti*) |
| NL003 | 1213 | CGTAAGGCCGCTCGTGAGCTG | 24661714 (*Drosophila melanogaster*) |
| NL003 | 1214 | GCGTGATGGATGGACTTGGCCAA | 90813959 (*Nasonia vitripennis*) |
| NL003 | 1215 | GCCAAGTCCATCCATCACGCCCG | 92467993 (*Drosophila erecta*) |
| NL003 | 1216 | GCCAAGTCCATCCATCACGCCCGT | 112349903 (*Helicoverpa armigera*) |
| NL003 | 1217 | CTCATCAGACAAAGACATATCAGAGT | 110671455 (*Diaphorina citri*) |
| NL003 | 1218 | CAGGAGTTGAAGATCATCGGAGA | 86464397 (*Acyrthosiphon pisum*) 92938865 (*Drosophila virilis*) |
| NL003 | 1219 | CAGGAGTTGAAGATCATCGGAGAGTATGG | 101417830 (*Plodia interpunctella*) 110254389 (*Spodoptera frugiperda*) |
| NL003 | 1220 | GAGTTGAAGATCATCGGAGAGTA | 112984021 (*Bornbyx mori*) |
| NL003 | 1221 | TCGCAGAAGCACATTGACTTCTC | 93002641 (*Drosophila mojavensis*) 92938865 (*Drosophila virilis*) |
| NL003 | 1222 | TTGAAGATCATCGGAGAGTATGG | 111158779 (*Myzus persicae*) |
| NL003 | 1223 | CAGAAGCACATTGACTTCTCGCTAA | 92232387 (*Drosophila willistoni*) |
| NL003 | 1224 | CTCCGTAACAAGCGTGAGGTGTGG | 92232387 (*Drosophila willistoni*) |
| NL003 | 1225 | CGTAACAAGCGTGAGGTGTGG | 110558371 (*Drosophila ananassae*) |
| NL003 | 1226 | GTCAAATACGCCCTGGCCAAGAT | 93001117 (*Drosophila grimshawi*) |
| NL004 | 1227 | TACGCCCATTTCCCCATCAACTGTGT | 14994663 (*Spodoptera frugiperda*), 53883415 (*Plutella xylostella*) |
| NL004 | 1228 | TGCTCTCACATCGAAAACATG | 22039837 (*Ctenocephalides felis*) |
| NL004 | 1229 | AACTTCCTGGGCGAGAAGTACATC | 25959088 (*Meladema coriacea*) |
| NL004 | 1230 | GCCGTGTACGCCCATTTCCCCATCAACTG | 25959088 (*Meladema coriacea*) |
| NL004 | 1231 | GTGTACGCCCATTTCCCCATCAACTGTGTGAC | 2761563 (*Drosophila melanogaster*) |
| NL004 | 1232 | GTGTACGCCCATTTCCCCATCAACTGTGT | 33354902 (*Drosophila yakuba*) |
| NL004 | 1233 | ATGCGTGCCGTGTACGCCCATTT | 33433477 (*Glossina morsitans*) |
| NL004 | 1234 | TCAGCTGCCCTCATCCAACAGTC | 33491496 (*Trichoplusia ni*) |
| NL004 | 1235 | AAGGATATTCGTAAATTCTTGGA | 37952094 (*Ips pini*), 56199511 (*Culicoides sonorensis*) |
| NL004 | 1236 | GCCCATTTCCCCATCAACTGTGT | 42766318 (*Armigeres subalbatus*) |
| NL004 | 1237 | AACTTCCTGGGCGAGAAGTACAT | 49547659 (*Rhipicephalus appendiculatus*) |
| NL004 | 1238 | AAGAACAAGGATATTCGTAAATTCTTGGA | 56152793 (*Rhynchosciara americana*) |
| NL004 | 1239 | AACTTCCTGGGCGAGAAGTACATCCG | 58079798 (*Amblyomma americanum*), 49554219 (*Boophilus microplus*) |
| NL004 | 1240 | CATTTCCCCATCAACTGTGTGAC | 60312171 (*Papilio dardanus*) |
| NL004 | 1241 | CGTAACTTCCTGGGCGAGAAGTACATCCG | 63516417 (*Ixodes scapularis*) |
| NL004 | 1242 | AGATCAGCTGCCCTCATCCAACA | 71539722 (*Diaphorina citri*) |
| NL004 | 1243 | GTGTACGCCCATTTCCCCATCAACTGTGT | 24583601 (*Drosophila melanogaster*) |
| NL004 | 1244 | TACGCCCATTTCCCCATCAACTGT | 113017826 (*Bemisia tabaci*) |
| NL004 | 1245 | TACGCCCATTTCCCCATCAACTGTGT | 110263092 (*Spodoptera frugiperda*) |
| NL004 | 1246 | GCCCATTTCCCCATCAACTGTGT | 94468811 (*Aedes aegypti*) |

TABLE 4-NL-continued

| Target ID | SEQ ID NO | Sequence * | Example Gi-number and species |
|---|---|---|---|
| NL004 | 1247 | ACACAGTTGATGGGGAAATGGGC | 90136736 (*Bicyclus anynana*) |
| NL004 | 1248 | GCCCATTTCCCCATCAACTGTGT | 110671493 (*Diaphorina citri*) 110249018 (*Spodoptera frugiperda*) |
| NL004 | 1249 | GTCACACAGTTGATGGGGAAATGGGC | 87266195 (*Choristoneura fumiferana*) |
| NL004 | 1250 | CCATTTCCCCATCAACTGTGT | 90981351 (*Aedes aegypti*) |
| NL005 | 1251 | AAGGGTAACGTATTCAAGAACAAGCG | 1900283 (*Drosophila melanogaster*) |
| NL005 | 1252 | AAGGGTAACGTATTCAAGAACAAG | 25956594 (*Biphyllus lunatus*) |
| NL005 | 1253 | CGTGTATTGATGGAGTTCATTCA | 30124405 (*Toxoptera citricida*), 60294294 (*Homalodisca coagulata*), 71046487 (*Oncometopia nigricans*), 73612243 (*Aphis gossypii*) |
| NL005 | 1254 | AAAGGTCAAGGAGGCCAAGAAG | 67875089 (*Drosophila pseudoobscura*) |
| NL005 | 1255 | AAGATGTTGAACGACCAGGCTGAAGC | 77324118 (*Chironomus tentans*) |
| NL005 | 1256 | ACGTTACCCTTAGCCTTCATGTA | 90812513 (*Nasonia giraulti*) |
| NL005 | 1257 | AAGGGTAACGTATTCAAGAACAAGCG | 45552830 (*Drosophila melanogaster*) |
| NL005 | 1258 | CGTGTATTGATGGAGTTCATTCA | 112433619 (*Myzus persicae*) |
| NL005 | 1259 | AGGTCAAGGAGGCCAAGAAGC | 92941126 (*Drosophila virilis*) |
| NL005 | 1260 | ACGTTACCCTTAGCCTTCATGTA | 90812513 (*Nasonia giraulti*) |
| NL005 | 1261 | AAGGGTAACGTATTCAAGAACAAGCG | 45552830 (*Drosophila melanogaster*) |
| NL006 | 1262 | AGTCCCAGGAACACCTATCAG | 21464337 (*Drosophila melanogaster*) |
| NL006 | 1263 | ATTATTCCCTTCCCCGATCACAA | 24646762 (*Drosophila melanogaster*) |
| NL006 | 1264 | CACGCTATCCCATCTCGTATGACAATTGG | 24646762 (*Drosophila melanogaster*) |
| NL006 | 1265 | TACAAGTTCTGCAAAATTCGAGT | 49573116 (*Boophilus microplus*) |
| NL006 | 1266 | ATGACAATTGGCCATTTAATTGAATG | 50564037 (*Homalodisca coagulata*) |
| NL006 | 1267 | ACCTACACGCACTGCGAGATCCA | 58384759 (*Anopheles gambiae* str. PEST) |
| NL006 | 1268 | GGTGTGGTGGAGTACATTGACAC | 58384759 (*Anopheles gambiae* str. PEST) |
| NL006 | 1269 | ATTATTCCCTTCCCCGATCACAA | 24646762 (*Drosophila melanogaster*) |
| NL006 | 1270 | AGTCCCAGGAACACCTATCAG | 22026793 (*Drosophila melanogaster*) |
| NL006 | 1271 | CACGCTATCCCATCTCGTATGACAATTGG | 24646762 (*Drosophila melanogaster*) |
| NL006 | 1272 | TCTCGTATGACAATTGGCCATTT | 93000469 (*Drosophila mojavensis*) |
| NL007 | 1273 | GCAAACAAGTCATGATGTTCAG | 15354019 (*Apis mellifera*) |
| NL007 | 1274 | GGTATGGGAAAAACTGCTGTATTTGTGTT | 15354019 (*Apis mellifera*) |
| NL007 | 1275 | GAATGCATTCCTCAAGCTGTA | 21068658 (*Chironomus tentans*) |
| NL007 | 1276 | TGCAAGAAATTCATGCAAGATCC | 21068658 (*Chironomus tentans*) |
| NL007 | 1277 | TTCCAAATCAGCAAAGAGTATGA | 2890413 (*Drosophila melanogaster*) |
| NL007 | 1278 | GATGACGAGGCCAAGCTGACGCT | 49536419 (*Rhipicephalus appendiculatus*) |
| NL007 | 1279 | TGTGGTTTTGAACATCCATCTGAAGTACAACA | 60308907 (*Hister* sp.) |
| NL007 | 1280 | GAAAACGAAAAGAACAAAAAG | 77642464 (*Aedes aegypti*) |
| NL007 | 1281 | GGTATGGGAAAAACTGCTGTATTTGTGTT | 110759359 (*Apis mellifera*) |
| NL007 | 1282 | GCAAACAAGTCATGATGTTCAG | 110759359 (*Apis mellifera*) |
| NL007 | 1283 | CTGCAGCAGCACTATGTCAAACTCAA | 90137538 (*Spodoptera frugiperda*) |

TABLE 4-NL-continued

| Target ID | SEQ ID NO | Sequence * | Example Gi-number and species |
|---|---|---|---|
| NL007 | 1284 | GAAAACGAAAAGAACAAAAAG | 94468805 (*Aedes aegypti*) |
| NL008 | 1285 | TGCCAAGCCTAAAGATTGGG | 60315277 (*Dysdera erythrina*) |
| NL008 | 1286 | ATGTTCAAGAAAGTTAATGCTAGAGA | 60336214 (*Homalodisca coagulata*) |
| NL008 | 1287 | GAGTTGTTGGTGTTCTTTGGGATG | 66522334 (*Apis mellifera*) |
| NL008 | 1288 | TTTCAAACAGTTTTGCAGTTCC | 75735289 (*Tribolium castaneum*) |
| NL008 | 1289 | GAGTTGTTGGTGTTCTTTGGGATG | 110762109 (*Apis mellifera*) |
| NL010_1 | 1290 | AAGGACCTGACTGCCAAGCAG | 2761430 (*Drosophila melanogaster*) |
| NL010_1 | 1291 | GCCAAGCAGATCCAGGACATG | 49559867 (*Boophilus microplus*) |
| NL010_1 | 1292 | TGCTCGAAGAGCTACGTGTTCCG | 49559867 (*Boophilus microplus*) |
| NL010_1 | 1293 | AAGAGCTACGTGTTCCGTGGC | 92043082 (*Drosophila willistoni*) |
| NL010_1 | 1294 | AAGGACCTGACTGCCAAGCAG | 92481328 (*Drosophila erecta*) 28571527 (*Drosophila melanogaster*) |
| NL010_2 | 1295 | ATGGACACATTTTTCCAAATTCTCAT | 33427937 (*Glossina morsitans*) |
| NL010_2 | 1296 | ACCAGCAGTATTCAACCCGACA | 47520567 (*Acyrthosiphon pisum*) |
| NL010_2 | 1297 | TATTGATGGACACATTTTTCCA | 47520567 (*Acyrthosiphon pisum*) |
| NL010_2 | 1298 | TTCAACAACAGTCCTGATGAAAC | 55891325 (*Locusta migratoria*) |
| NL0102 | 1299 | ATGGACACATTTTTCCAAATT | 56151768 (*Rhynchosciara americana*), 75736992 (*Tribolium castaneum*) |
| NL010_2 | 1300 | CCGCAGTTCATGTACCATCTGCG | 6932015 (*Anopheles gambiae*), 29558345 (*Bombyx mori*) |
| NL010_2 | 1301 | ATGGACACATTTTTCCAAATT | 91086194 (*Tribolium castaneum*) |
| NL011 | 1302 | AAGAAGTATGTTGCCACCCTTGG | 21640529 (*Amblyomma variegatum*) |
| NL011 | 1303 | GACATCAAGGACAGGAAAGTCAAGGCCAAGAGCATAGT | 25959135 (*Meladema coriacea*) |
| NL011 | 1304 | CAACTACAACTTCGAGAAGCCGTTCCTGTGG | 25959135 (*Meladema coriacea*), 77646995 (*Aedes aegypti*) |
| NL011 | 1305 | TACAAGAACGTTCCCAACTGGCA | 3114090 (*Drosophila melanogaster*) |
| NL011 | 1306 | TGCGAAAACATTCCCATTGTACT | 37951963 (*Ips pini*) |
| NL011 | 1307 | AGGAAGAAGAACCTTCAGTACTACGA | 40544671 (*Tribolium castaneum*) |
| NL011 | 1308 | AGCAACTACAACTTCGAGAAGCC | 49565237 (*Boophilus microplus*), 49538692 (*Rhipicephalus appendiculatus*) |
| NL011 | 1309 | AACAAAGTAGACATCAAGGACAGGAAAGTCAA | 76552920 (*Spodoptera frugiperda*) |
| NL011 | 1310 | CCCAACTGGCACAGAGATTTAGTG | 78230577 (*Heliconius erato/himera* mixed EST library) |
| NL011 | 1311 | GATGGTGGTACCGGCAAAACTAC | 78538667 (*Glossina morsitans*) |
| NL011 | 1312 | TACAAGAACGTTCCCAACTGGCAC | 84267747 (*Aedes aegypti*) |
| NL011 | 1313 | AACAAAGTAGACATCAAGGACAGGAAAGTCAA | 110263840 (*Spodoptera frugiperda*) |
| NL011 | 1314 | TTGACTTTCCTGTCCTTGATGTC | 90136305 (*Bicyclus anynana*) |
| NL011 | 1315 | GACATCAAGGACAGGAAAGTCAAGGC | 90813103 (*Nasonia vitripennis*) |
| NL011 | 1316 | AGGAAGAAGAACCTTCAGTACTACGA | 91091115 (*Tribolium castaneum*) |
| NL011 | 1317 | GATGTCGTAGTACTGAAGGTTCTT | 90136305 (*Bicyclus anynana*) |
| NL011 | 1318 | CAACTACAACTTCGAGAAGCCGTTCCTGTGG | 90977910 (*Aedes aegypti*) |
| NL011 | 1319 | CCAACCTGGAGTTCGTCGCCATGCC | 92465523 (*Drosophila erecta*) |

TABLE 4-NL-continued

| Target ID | SEQ ID NO | Sequence * | Example Gi-number and species |
|---|---|---|---|
| NL011 | 1320 | GAATTTGAAAAGAAGTATGTTGC | 113015058 (*Bemisia tabaci*) |
| NL011 | 1321 | CTTCAGTACTACGACATCAGTGCGAA | 110086408 (*Amblyomma cajennense*) |
| NL011 | 1322 | AGCAACTACAACTTCGAGAAGCC | 110086408 (*Amblyomma cajennense*) |
| NL011 | 1323 | AAGCTGATCGGTGACCCCAACCTGGAGTT | 110086408 (*Amblyomma cajennense*) |
| NL012 | 1324 | CACAGTTTGAACAGCAAGCTGG | 29552409 (*Bombyx mori*) |
| NL012 | 1325 | GCAGCAGACGCAGGCACAGGTAGA | 77823921 (*Aedes aegypti*) |
| NL012 | 1326 | CACAGTTTGAACAGCAAGCTGG | 94435913 (*Bombyx mori*) |
| NL013 | 1327 | CAAGCGAAGATGTTGGACATGCT | 15536506 (*Drosophila melanogaster*) |
| NL013 | 1328 | ATGGTGGTGGGCTGGTACCACTCGCACCC | 49547019 (*Rhipicephalus appendiculatus*) |
| NL013 | 1329 | GTGGTGGGCTGGTACCACTCGCACCC | 58079586 (*Amblyomma americanum*) |
| NL013 | 1330 | GTGGGCTGGTACCACTCGCACCC | 82848521 (*Boophilus microplus*) |
| NL013 | 1331 | AAGATGTTGGACATGCTAAAGCAGACAGG | 92229701 (*Drosophila willistoni*) |
| NL013 | 1332 | TGTCGGGTGTCGACATCAACAC | 92962655 (*Drosophila ananassae*) |
| NL013 | 1333 | GTTCCCATGGAAGTTATGGGC | 112433067 (*Myzus persicae*) |
| NL013 | 1334 | GTGGGCTGGTACCACTCGCACCC | 110085175 (*Amblyomma cajennense*) |
| NL014 | 1335 | GAGATCGATGCCAAGGCCGAGGA | 1033187 (*Drosophila melanogaster*) |
| NL014 | 1336 | GAATTCAACATTGAAAAGGGA | 16900951 (*Ctenocephalides felis*) |
| NL014 | 1337 | GAAGAATTCAACATTGAAAAGGG | 47518467 (*Acyrthosiphon pisum*) |
| NL014 | 1338 | GAAGCCAATGAGAAAGCCGAAGA | 47518467 (*Acyrthosiphon pisum*) |
| NL014 | 1339 | TCGTCAAACATGCTGAACCAAGC | 61954844 (*Tribolium castaneum*) |
| NL014 | 1340 | TTTCATTGAGCAAGAAGCCAATGA | 62239529 (*Diabrotica virgifera*), 76169390 (*Diploptera punctata*), 61954844 (*Tribolium castaneum*), 16900951 (*Ctenocephalides felis*) |
| NL014 | 1341 | CAAGAAGCCAATGAGAAAGCCGA | 111160670 (*Myzus persicae*) |
| NL014 | 1342 | TTTCATTGAGCAAGAAGCCAATGA | 91092061 (*Tribolium castaneum*) |
| NL014 | 1343 | AGAAGCCAATGAGAAAGCCGA | 112432414 (*Myzus persicae*) |
| NL014 | 1344 | TCGTCAAACATGCTGAACCAAGC | 91092061 (*Tribolium castaneum*) |
| NL014 | 1345 | GCCAATGAGAAAGCCGAAGAGATCGATGCCAA | 93001435 (*Drosophila grimshawi*) |
| NL014 | 1346 | AAAGCCGAAGAGATCGATGCCAA | 92936169 (*Drosophila virilis*) |
| NL014 | 1347 | GAGATCGATGCCAAGGCCGAGGA | 24644299 (*Drosophila melanogaster*) |
| NL014 | 1348 | GAAGAATTCAACATTGAAAAGGG | 86463006 (*Acyrthosiphon pisum*) 111160670 (*Myzus persicae*) |
| NL014 | 1349 | GAAGAATTCAACATTGAAAAGGGAAGGCT | 90819999 (*Graphocephala atropunctata*) |
| NL014 | 1350 | AAGAATTCAACATTGAAAAGGG | 111158385 (*Myzus persicae*) |
| NL015 | 1351 | GAGGTGCTGCGCATCCACACCAA | 18887285 (*Anopheles gambiae*) |
| NL015 | 1352 | ATCCATGTGCTGCCCATTGATGA | 21641659 (*Amblyomma variegatum*) |
| NL015 | 1353 | CATGTGCTGCCCATTGATGAT | 22039735 (*Ctenocephalides felis*) |
| NL015 | 1354 | CTGCGCATCCACACCAAGAACATGAAGTTGG | 22474136 (*Helicoverpa armigera*) |
| NL015 | 1355 | TTCTTCTTCCTCATCAACGGACC | 49552586 (*Rhipicephalus appendiculatus*) |
| NL015 | 1356 | GAGATGGTGGAGTTGCCGCTG | 58371722 (*Lonomia obliqua*) |

TABLE 4-NL-continued

| Target ID | SEQ ID NO | Sequence * | Example Gi-number and species |
|---|---|---|---|
| NL015 | 1357 | CAGATCAAAGAGATGGTGGAG | 92947821 (Drosophila ananassae) |
| NL015 | 1358 | ATCAACGGACCCGAGATTATG | 92947821 (Drosophila ananassae) |
| NL015 | 1359 | ATGAAGATGATGGCCGGTGCGTT | 92470977 (Drosophila erecta) |
| NL015 | 1360 | CCGGCCATCATCTTCATCGATGAG | 92480997 (Drosophila erecta) |
| NL015 | 1361 | ATCATCTTCATCGATGAGCTGGACGC | 99007898 (Leptinotarsa decemlineata) |
| NL015 | 1362 | CAGCTGCTGACGCTGATGGACGG | 92941440 (Drosophila virilis) |
| NL015 | 1363 | ATCGACATTGGCATTCCCGATGCCACCGG | 92947821 (Drosophila ananassae) |
| NL016 | 1364 | TCTATGGAGAACGTGTGCCTGTTCTTGAAC | 27372076 (Spodoptera littoralis) |
| NL016 | 1365 | TACCAGTGCGAGAAGCACGTGCT | 2921501 (Culex pipiens) |
| NL016 | 1366 | ATGGAGAACGTGTGCCTGTTCTTGAACCTGGC | 31206154 (Anopheles gambiae str. PEST) |
| NL016 | 1367 | CGTGGCCAGAAAATCCCCATCTT | 3945243 (Drosophila melanogaster) |
| NL016 | 1368 | TGGCCTACCAGTGCGAGAAGCACGTG | 4680479 (Aedes aegypti) |
| NL016 | 1369 | TGGCCACCATCTACGAGCGCGCCGG | 53883819 (Plutella xylostella) |
| NL016 | 1370 | ATGGAGAACGTGTGCCTGTTCTTGAA | 67883622 (Drosophila pseudoobscura) |
| NL016 | 1371 | CCCGAGGAAATGATCCAGACTGG | 67883622 (Drosophila pseudoobscura) |
| NL016 | 1372 | TGGCCTACCAGTGCGAGAAGCACGTGCT | 67883622 (Drosophila pseudoobscura), 31206154 (Anopheles gambiae str. PEST) |
| NL016 | 1373 | GAGGAGGTGCCCGGCCGTCGTGGTTTCCCCGG TTACATGTACACCGAT | 67896654 (Drosophila pseudoobscura) |
| NL016 | 1374 | GAGGGTCGCAACGGCTCCATCAC | 67896654 (Drosophila pseudoobscura) |
| NL016 | 1375 | GAGGTGCCCGGCCGTCGTGGTTTCCCCGGTTAC ATGTACACCGAT | 75710699 (Tribolium castaneum) |
| NL016 | 1376 | ATGGAGAACGTGTGCCTGTTCTTGAAC | 76554661 (Spodoptera frugiperda) |
| NL016 | 1377 | TGGCCTACCAGTGCGAGAAGCACGTGCTCGTCA TCCT | 9992660 (Drosophila melanogaster) |
| NL016 | 1378 | CGTCGTGGTTTCCCCGGTTACATGTACACCGAT | 9992660 (Drosophila melanogaster), 2921501 (Culex pipiens), 62239897 (Diabrotica virgifera) |
| NL016 | 1379 | TGGTCGCGTATCTATCCCGAGGAAATGATCCAG AC | 92999374 (Drosophila grimshawi) |
| NL016 | 1380 | TGGTCGCGTATCTATCCCGAGGAAATGATCCAG ACTGG | 92940538 (Drosophila virilis) |
| NL016 | 1381 | TCTATGGAGAACGTGTGCCTGTTCTTGAAC | 92938622 (Drosophila virilis) |
| NL016 | 1382 | ATGGAGAACGTGTGCCTGTTCTTGAAC | 92950254 (Drosophila ananassae) 90137502 (Spodoptera frugiperda) |
| NL016 | 1383 | AACGTGTGCCTGTTCTTGAAC | 92946927 (Drosophila ananassae) |
| NL016 | 1384 | TGGCCTACCAGTGCGAGAAGCACGTGCT | 24646342 (Drosophila melanogaster) 92231646 (Drosophila willistoni) |
| NL016 | 1385 | TGGCCTACCAGTGCGAGAAGCACGTGCTCGTCA TCCT | 107256717 (Drosophila melanogaster) |
| NL016 | 1386 | GCCTACCAGTGCGAGAAGCACGTGCT | 92985459 (Drosophila grimshawi) |
| NL016 | 1387 | GAGGAGGTGCCCGGCCGTCGTGGTTTCCCCGG TTACATGTACAC | 92938622 (Drosophila virilis) |
| NL016 | 1388 | GAGGAGGTGCCCGGCCGTCGTGGTTTCCCCGG TTACATGTACACCGAT | 92477818 (Drosophila erecta) |

TABLE 4-NL-continued

| Target ID | SEQ ID NO | Sequence * | Example Gi-number and species |
|---|---|---|---|
| NL016 | 1389 | GAGGTGCCCGGCCGTCGTGGTTTCCCCGGTTAC ATGTACACCGAT | 91090030 (*Tribolium castaneum*) |
| NL016 | 1390 | CGTCGTGGTTTCCCCGGTTACAT | 104530890 (*Belgica antarctica*) |
| NL016 | 1391 | CGTCGTGGTTTCCCCGGTTACATGTACACCGAT | 92981037 (*Drosophila grimshawi*) 24646342 (*Drosophila melanogaster*) |
| NL016 | 1392 | CGTGGTTTCCCCGGTTACATGTACACCGAT | 92957249 (*Drosophila ananassae*) |
| NL016 | 1393 | ATCGGTGTACATGTAACCGGGGAAACCA | 103744758 (*Drosophila melanogaster*) |
| NL016 | 1394 | CGTCCGGCGCGCTCGTAGATGGT | 91829127 (*Bombyx mori*) |
| NL016 | 1395 | GAGGGTCGCAACGGCTCCATCAC | 92957249 (*Drosophila ananassae*) |
| NL018 | 1396 | CGGACGTGGCCTGGTTCATCA | 92479742 (*Drosophila erecta*) |
| NL019 | 1397 | GTGGTGTACGACTGCACCGACCAGGAGTCGTTC AACAAC | 84343006 (*Aedes aegypti*) |
| NL019 | 1398 | GAAAGTTACATCAGTACCATTGGTGT | 113018639 (*Bemisia tabaci*) |
| NL019 | 1399 | CACCGACCAGGAGTCGTTCAACAAC | 85857059 (*Aedes aegypti*) |
| NL019 | 1400 | AGTACCATTGGTGTAGATTTTAAAAT | 91087112 (*Tribolium castaneum*) |
| NL019 | 1401 | ATTGGTGTAGATTTTAAAATTAG | 78542465 (*Glossina morsitans*) |
| NL019 | 1402 | GGTGTAGATTTTAAAATTAGAAC | 92232411 (*Drosophila willistoni*) |
| NL019 | 1403 | GGTGTAGATTTTAAAATTAGAACAAT | 90986845 (*Aedes aegypti*) |
| NL019 | 1404 | GTTCTAATTTTAAAATCTACAC | 92043152 (*Drosophila willistoni*) |
| NL019 | 1405 | TGGGACACGGCCGGCCAGGAG | 91091115 (*Tribolium castaneum*) |
| NL019 | 1406 | TGGGACACGGCCGGCCAGGAGCG | 90982219 (*Aedes aegypti*) |
| NL019 | 1407 | TGGGACACGGCCGGCCAGGAGCGGT | 94433465 (*Bombyx mori*) |
| NL019 | 1408 | GACCAGCTGGGCATTCCGTTCCT | 10708384 (*Amblyomma americanum*) |
| NL019 | 1409 | ATTGGTGTAGATTTTAAAATT | 18864897 (*Anopheles gambiae*) |
| NL019 | 1410 | TGGGACACGGCCGGCCAGGAGCGGTT | 18888926 (*Anopheles gambiae*) |
| NL019 | 1411 | CAGGAGCGGTTCCGCACGATCAC | 21640713 (*Amblyomma variegatum*) |
| NL019 | 1412 | ATTGGTGTAGATTTTAAAATTAGAAC | 22039832 (*Ctenocephalides felis*) |
| NL019 | 1413 | ATTGGTGTAGATTTTAAAATTAG | 33378174 (*Glossina morsitans*) |
| NL019 | 1414 | TGGGACACGGCCGGCCAGGAG | 3738872 (*Manduca sexta*), 25959135 (*Meladema coriacea*), 40542849 (*Tribolium castaneum*), 67840088 (*Drosophila pseudoobscura*) |
| NL019 | 1415 | TGGGACACGGCCGGCCAGGAGCGGT | 4161805 (*Bombyx mori*) |
| NL019 | 1416 | GATGACACATACACAGAAAGTTACATCAGTAC | 50562545 (*Homalodisca coagulata*), 71047909 (*Oncometopia nigricans*) |
| NL019 | 1417 | ACGGCCGGCCAGGAGCGGTTCCG | 58378591 (*Anopheles gambiae* str. PEST) |
| NL019 | 1418 | AGTACCATTGGTGTAGATTTTAAAAT | 61954135 (*Tribolium castaneum*) |
| NL019 | 1419 | TAAAGCTTCAGATTTGGGACAC | 68758530 (*Acanthoscurria gomesiana*) |
| NL019 | 1420 | ATTTGGGACACGGCCGGCCAGGA | 77667315 (*Aedes aegypti*) |
| NL019 | 1421 | GTGGTGTACGACTGCACCGACCAGGAGTCGTTC AACAAC | 77705629 (*Aedes aegypti*) |
| NL019 | 1422 | GGTGTAGATTTTAAAATTAGAACAAT | 77890715 (*Aedes aegypti*) |

TABLE 4-NL-continued

| Target ID | SEQ ID NO | Sequence * | Example Gi-number and species |
|---|---|---|---|
| NL019 | 1423 | TGGGACACGGCCGGCCAGGAGCG | 82851662 (*Boophilus microplus*), 49536894 (*Rhipicephalus appendiculatus*) |
| NL022 | 1424 | TCTTCCTCACCGGTCAGGAGGAGAT | 6928515 (*Anopheles gambiae*) |
| NL022 | 1425 | AAATTCTCCGAGTTTTTCGACGATGC | 91082872 (*Tribolium castaneum*) |
| NL022 | 1426 | TTCCTCACCGGTCAGGAGGAGAT | 90976120 (*Aedes aegypti*) |
| NL022 | 1427 | TAGTATTGGCCACAAATATTGCAGA | 92042565 (*Drosophila willistoni*) |
| NL023 | 1428 | TATTTGAACATATGGGTGCCGCA | 20384699 (*Plutella xylostella*) |
| NL023 | 1429 | GAGGGAGAGGAAATGTGGAATCC | 22085301 (*Helicoverpa armigera*) |
| NL023 | 1430 | CCGAAGATTGTCTGTATTTGAA | 27531022 (*Apis mellifera*) |
| NL023 | 1431 | GATTCCGTTTGCGAAACCTCC | 57929927 (*Anopheles gambiae* str. PEST) |
| NL023 | 1432 | GGTGCGTTCGGCTTCCTCTACCT | 58380563 (*Anopheles gambiae* str. PEST) |
| NL023 | 1433 | CAATTCAATGCTAGGGAAAGG | 110759012 (*Apis mellifera*) |
| NL023 | 1434 | GAGGGAGAGGAAATGTGGAATCC | 55793188 (*Helicoverpa assulta*) |
| NL023 | 1435 | CCGAAGATTGTCTGTATTTGAA | 58585075 (*Apis mellifera*) |
| NL023 | 1436 | GACGTCATCGTCGCCTCCATGCA | 91077117 (*Tribolium castaneum*) |
| NL027 | 1437 | GGAGACCCTGGAGCTGGTGCG | 49543279 (*Rhipicephalus appendiculatus*) |

TABLE 4-CS

| Target ID | SEQ ID NO | Sequence * | Example Gi-number and species |
|---|---|---|---|
| CS001 | 1730 | AAAGCATGGATGTTGGACAAA | 73619372 (*Aphis gossypii*); 77325485 (*Chironomus tentans*); 22474232 (*Helicoverpa armigera*); 37951951 (*Ips pini*); 60305420 (*Mycetophagus quadripustulatus*); 84647995 (*Myzus persicae*) |
| CS001 | 1731 | AAAGCATGGATGTTGGACAAACT | 40877657 (*Bombyx mori*); 103783745 (*Heliconius erato*); 55904580 (*Locusta migratoria*); 101413238 (*Plodia interpunctella*) |
| CS001 | 1732 | AACCGGCTCAAGTACGCGCTCAC | 22474232 (*Helicoverpa armigera*) |
| CS001 | 1733 | AACCGGCTCAAGTACGCGCTCACCGG | 90134075 (*Bicyclus anynana*) |
| CS001 | 1734 | AAGATCATGGACTTCATCAAGTT | 90134075 (*Bicyclus anynana*) |
| CS001 | 1735 | ACCAGATTGAACAACGTGTTCAT | 71536878 (*Diaphorina citri*) 3658573 (*Manduca sexta*) |
| CS001 | 1736 | ATCATGGACTTCATCAAGTTTGAATC | 103783745 (*Heliconius erato*) |
| CS001 | 1737 | CAAGATCATGGACTTCATCAAGTT | 3478550 (*Antheraea yamamai*) |
| CS001 | 1738 | CCCCACAAGTTGCGCGAGTGC | 63011732 (*Bombyx mori*) |
| CS001 | 1739 | CCCGCTGGATTTATGGATGTTGT | 101403940 (*Plodia interpunctella*) |
| CS001 | 1740 | CCTCCAAGATCATGGACTTCATCAAGTT | 22474232 (*Helicoverpa armigera*) |
| CS001 | 1741 | CCTGCCGCTGGTGATCTTCCT | 27597800 (*Anopheles gambiae*) |
| CS001 | 1742 | CGACGGGCCCCAAGAACGTGCC | 22474232 (*Helicoverpa armigera*) |
| CS001 | 1743 | CTCATCAAGGTCAACGACTCC | 103783745 (*Heliconius erato*) 112350001 (*Helicoverpa armigera*) 101418268 (*Plodia interpunctella*) |

TABLE 4-CS-continued

| Target ID | SEQ ID NO | Sequence * | Example Gi-number and species |
|---|---|---|---|
| CS001 | 1744 | CTCATCAAGGTCAACGACTCCATCCAGCTCGACAT | 3738704 (Manduca sexta) |
| CS001 | 1745 | CTCATCAAGGTCAACGACTCCATCCAGCTCGACATCGCCACCT | 53884106 (Plutella xylostella) |
| CS001 | 1746 | CTGCCGCTGGTGATCTTCCTC | 27603050 (Anopheles gambiae) |
| CS001 | 1747 | GACCCCACATATCCCGCTGGATT | 103783745 (Heliconius erato) |
| CS001 | 1748 | GCAGCGACTTATCAAAGTTGA | 109978109 (Gryllus pennsylvanicus) |
| CS001 | 1749 | GCATGGATGTTGGACAAACTGGG | 67899746 (Drosophila pseudoobscura) |
| CS001 | 1750 | GCCACCTCCAAGATCATGGACTTCAT | 110259010 (Spodoptera frugiperda) |
| CS001 | 1751 | GCGCGTGGCGACGGGCCCCAAGAACGTGCC | 53884106 (Plutella xylostella) |
| CS001 | 1752 | GCTGGATTTATGGATGTTGTTT | 29553519 (Bombyx mori) |
| CS001 | 1753 | GGCTCAAGTACGCGCTCACCGG | 5498893 (Antheraea yamamai) |
| CS001 | 1754 | GTGGGCACCATCGTGTCCCGCGAG | 3953837 (Bombyx mandarina) 53884106 (Plutella xylostella) |
| CS001 | 1755 | GTGGGCACCATCGTGTCCCGCGAGCG | 3478550 (Antheraea yamamai) |
| CS001 | 1756 | GTGGGCACCATCGTGTCCCGCGAGCGACATCCCGG | 22474232 (Helicoverpa armigera) |
| CS001 | 1757 | TAAAGCATGGATGTTGGACAA | 58371410 (Lonomia obliqua) |
| CS001 | 1758 | TAAAGCATGGATGTTGGACAAA | 60311985 (Papilio dardanus) 31366663 (Toxoptera citricida) |
| CS001 | 1759 | TAAAGCATGGATGTTGGACAAACT | 109978109 (Gryllus pennsylvanicus) |
| CS001 | 1760 | TAAAGCATGGATGTTGGACAAACTGGG | 98994282 (Antheraea mylitta) |
| CS001 | 1761 | TACAAGCTGTGCAAGGTGCGGCGCGTGGCGACGGGCCC | 98993531 (Antheraea mylitta) |
| CS001 | 1762 | TACAAGCTGTGCAAGGTGCGGCGCGTGGCGACGGGCCCAA | 5498893 (Antheraea yamamai) |
| CS001 | 1763 | TACCCCGACCCACTCATCAAGGT | 90134075 (Bicyclus anynana) |
| CS001 | 1764 | TGAACAACGTGTTCATAATCGG | 98993531 (Antheraea mylitta) |
| CS001 | 1765 | TGCGCGAGTGCCTGCCGCTGGT | 22474232 (Helicoverpa armigera) |
| CS001 | 1766 | TGTATGATCACGGGAGGCCGTAACTTGGG | 60311445 (Euclidia glyphica) |
| CS001 | 1767 | TGTATGATCACGGGAGGCCGTAACTTGGGGCG | 3953837 (Bombyx mandarina) |
| CS001 | 1768 | TGTATGATCACGGGAGGCCGTAACTTGGGGCGCGTGGGCACCATCGTGTCCCGCGAG | 91826697 (Bombyx mori) |
| CS001 | 1769 | TGTGCAAGGTGCGGCGCGTGGCGACGGGCCCCAAG | 3478550 (Antheraea yamamai) |
| CS001 | 1770 | TTGAACAACGTGTTCATAATCGGCAAGGGCACGAA | 3953837 (Bombyx mandarina) 40915191 (Bombyx mori) |
| CS002 | 1771 | ATTGAGGCCCAAAGGGAAGCGCTAGAAGG | 91849872 (Bombyx mori) |
| CS002 | 1772 | CACGATCTGATGGATGACATTG | 33498783 (Anopheles gambiae) |
| CS002 | 1773 | GAGTTTCTTTAGTAAAGTATTCGGTGG | 110762684 (Apis mellifera) |
| CS002 | 1774 | TATGAAAAGCAGCTTACCCAGAT | 49552807 (Rhipicephalus appendiculatus) |
| CS003 | 1775 | AGGCACATCCGTGTCCGCAAGCA | 10707186 (Amblyomma americanum) |
| CS003 | 1776 | AAGATTGAGGACTTCTTGGAA | 60295192 (Homalodisca coagulata) |
| CS003 | 1777 | AAGCACATTGACTTCTCGCTGAA | 92219983 (Drosophila willistoni) |

TABLE 4-CS-continued

| Target ID | SEQ ID NO | Sequence * | Example Gi-number and species |
|---|---|---|---|
| CS003 | 1778 | ATCAGACAGAGGCACATCCGTGT | 27260897 (*Spodoptera frugiperda*) |
| CS003 | 1779 | ATCCGTAAGGCTGCCCGTGAG | 101413529 (*Plodia interpunctella*) |
| CS003 | 1780 | ATCCGTAAGGCTGCCCGTGAGCTG | 92042852 (*Drosophila willistoni*) |
| CS003 | 1781 | ATCCGTAAGGCTGCCCGTGAGCTGCT | 92959651 (*Drosophila ananassae*) 112349903 (*Helicoverpa armigera*) |
| CS003 | 1782 | ATCCGTAAGGCTGCCCGTGAGCTGCTCAC | 90138123 (*Spodoptera frugiperda*) |
| CS003 | 1783 | CACATCCGTGTCCGCAAGCAAG | 60306665 (*Sphaerius* sp.) |
| CS003 | 1784 | CACATCCGTGTCCGCAAGCAAGT | 77329341 (*Chironomus tentans*) |
| CS003 | 1785 | CACATCCGTGTCCGCAAGCAAGTTG | 60306676 (*Sphaerius* sp.) |
| CS003 | 1786 | CGCAACAAGCGTGAGGTGTGG | 92473214 (*Drosophila erecta*) 67888665 (*Drosophila pseudoobscura*) |
| CS003 | 1787 | CGTGTCCGCAAGCAAGTTGTGAACATCCC | 90134575 (*Bicyclus anynana*) 29553137 (*Bombyx mori*) |
| CS003 | 1788 | CTCGCTGAAGTCTCCGTTCGGCGGCGGCCG | 3986375 (*Antheraea yamamai*) |
| CS003 | 1789 | CTCGGTCTGAAGATTGAGGACTT | 112349903 (*Helicoverpa armigera*) 49532931 (*Plutella xylostella*) |
| CS003 | 1790 | CTGGACTCTGGCAAGCACATTGACTTCTC | 29553137 (*Bombyx mori*) 58371398 (*Lonomia obliqua*) |
| CS003 | 1791 | GACTTCTCGCTGAAGTCTCCGTTCGGCGGCGG | 60312414 (*Papilio dardanus*) |
| CS003 | 1792 | GACTTCTCGCTGAAGTCTCCGTTCGGCGGCGGCCG | 49532931 (*Plutella xylostella*) |
| CS003 | 1793 | GAGGAGAAAGACCCTAAGAGGTTATTCGAAGGTAA | 37952462 (*Ips pini*) |
| CS003 | 1794 | GATCCGTAAGGCTGCCCGTGA | 67568544 (*Anoplophora glabripennis*) |
| CS003 | 1795 | GATCCGTAAGGCTGCCCGTGAGCTGCT | 67843629 (*Drosophila pseudoobscura*) 56772258 (*Drosophila virilis*) |
| CS003 | 1796 | GATTATGTACTCGGTCTGAAGATTGAGGACTT | 101413529 (*Plodia interpunctella*) |
| CS003 | 1797 | GGTCTGAAGATTGAGGACTTCTTGGA | 2699490 (*Drosophila melanogaster*) |
| CS003 | 1798 | GTGTGGAGGGTGAAGTACACGCT | 60312414 (*Papilio dardanus*) |
| CS003 | 1799 | GTGTTCAAGGCTGGTCTAGCTAAGTC | 78230982 (*Heliconius erato/himera* mixed EST library) |
| CS003 | 1800 | GTGTTGGATGAGAAGCAGATGAAGCTCGATTATGT | 112349903 (*Helicoverpa armigera*) |
| CS003 | 1801 | TGAAGATTGAGGACTTCTTGGA | 3986375 (*Antheraea yamamai*) |
| CS003 | 1802 | TGGACTCTGGCAAGCACATTGACTTCTC | 78230982 (*Heliconius erato/himera* mixed EST library) |
| CS003 | 1803 | TGGATGAGAAGCAGATGAAGCT | 60312414 (*Papilio dardanus*) |
| CS003 | 1804 | TGGTCTCCGCAACAAGCGTGAGGT | 76552467 (*Spodoptera frugiperda*) |
| CS003 | 1805 | TGGTCTCCGCAACAAGCGTGAGGTGTGG | 33528372 (*Trichoplusia ni*) |
| CS006 | 1806 | CGTATGACAATTGGTCACTTGATTGA | 91831926 (*Bombyx mori*) |
| CS006 | 1807 | GAAGATATGCCTTTCACTTGTGAAGG | 55801622 (*Acyrthosiphon pisum*) |
| CS006 | 1808 | GGAAAAACTATAACTTTGCCAGAAAA | 40926289 (*Bombyx mori*) |
| CS006 | 1809 | GGTGATGCTACACCATTTAACGATGCTGT | 31366154 (*Toxoptera citricida*) |
| CS006 | 1810 | TCTCGTATGACAATTGGTCACTTGAT | 49201759 (*Drosophila melanogaster*) |
| CS006 | 1811 | CTGTCAACGTGCAGAAGATCTC | 49573116 (*Boophilus microplus*) |

TABLE 4-CS-continued

| Target ID | SEQ ID NO | Sequence * | Example Gi-number and species |
|---|---|---|---|
| CS007 | 1812 | TGGATGAATGTGACAAAATGCTTGAA | 84114516 (*Blomia tropicalis*) |
| CS007 | 1813 | TTTATGCAAGATCCTATGGAAGT | 84114516 (*Blomia tropicalis*) |
| CS007 | 1814 | AAATTTATGCAAGATCCTATGGAAGTTTATGT | 78525380 (*Glossina morsitans*) |
| CS007 | 1815 | AATATGACTCAAGATGAGCGTCT | 90137538 (*Spodoptera frugiperda*) |
| CS007 | 1816 | ATGACTCAAGATGAGCGTCTCTCCCG | 103792212 (*Heliconius erato*) |
| CS007 | 1817 | ATGCAAGATCCTATGGAAGTTTA | 77336752 (*Chironomus tentans*) |
| CS007 | 1818 | ATGCAAGATCCTATGGAAGTTTATGT | 77873166 (*Aedes aegypti*) |
| CS007 | 1819 | CGCTATCAGCAGTTCAAAGATTTCCAGAAG | 77873166 (*Aedes aegypti*) |
| CS007 | 1820 | GAAAATGAAAGAATAAGAAG | 110759359 (*Apis mellifera*)<br>78525380 (*Glossina morsitans*) |
| CS007 | 1821 | GAAGTTCAACATGAATGTATTCC | 110759359 (*Apis mellifera*) |
| CS007 | 1822 | GATGAGCGTCTCTCCCGCTATCA | 40932719 (*Bombyx mori*) |
| CS007 | 1823 | TGCCAATTCAGAAAGATGAAGAAGT | 110759359 (*Apis mellifera*) |
| CS007 | 1824 | TGTAAGAAATTTATGCAAGATC | 45244844 (*Bombyx mori*) |
| CS009 | 1825 | AGGTGTGCGACGTGGACATCA | 92460383 (*Drosophila erecta*) |
| CS009 | 1826 | GACTTGAAGGAGCACATCAGGAA | 29534871 (*Bombyx mori*) |
| CS009 | 1827 | GGCCAGAACATCCACAACTGTGA | 29534871 (*Bombyx mori*) |
| CS009 | 1828 | TCTTGCGAGGGAGAGAATCCA | 111005781 (*Apis mellifera*) |
| CS011 | 1829 | AAAACTATTGTTTTCCACAGAAAAAGAA | 86465126 (*Bombyx mori*) |
| CS011 | 1830 | ATCAAGGACAGAAAAGTCAAAGC | 78230577 (*Heliconius erato/himera* mixed EST library) |
| CS011 | 1831 | ATCTCTGCCAAGTCAAACTACAA | 101406907 (*Plodia interpunctella*) |
| CS011 | 1832 | CAATGTGCCATCATCATGTTCGA | 110242457 (*Spodoptera frugiperda*) |
| CS011 | 1833 | CCCAACTGGCACAGAGATTTAGTGCG | 78230577 (*Heliconius erato/himera* mixed EST library) |
| CS011 | 1834 | GACACTTGACTGGAGAGTTCGAGAAAAGATA | 101410627 (*Plodia interpunctella*) |
| CS011 | 1835 | GATATCAAGGACAGAAAAGTCAA | 60312108 (*Papilio dardanus*) |
| CS011 | 1836 | GCCAAGTCAAACTACAATTTCGA | 67873076 (*Drosophila pseudoobscura*) |
| CS011 | 1837 | GCTGGCCAAGAAAAGTTTGGTGGT | 111031693 (*Apis mellifera*) |
| CS011 | 1838 | GGCCAAGAAAAGTTTGGTGGTCTCCG | 84267747 (*Aedes aegypti*) |
| CS011 | 1839 | TACAAAAATGTACCCAACTGGCA | 92963426 (*Drosophila grimshawi*)<br>37951963 (*Ips pini*) |
| CS011 | 1840 | TACAAAAATGTACCCAACTGGCACAGAGA | 60312108 (*Papilio dardanus*) |
| CS011 | 1841 | TATGGGATACTGCTGGCCAAGAA | 40929360 (*Bombyx mori*) |
| CS011 | 1842 | TATGGGATACTGCTGGCCAAGAAA | 110749704 (*Apis mellifera*) |
| CS011 | 1843 | TGGGATACTGCTGGCCAAGAA | 73618835 (*Aphis gossypii*)<br>112432160 (*Myzus persicae*) |
| CS011 | 1844 | TGTGCCATCATCATGTTCGATGT | 84346664 (*Aedes aegypti*) |
| CS011 | 1845 | TTGACTGGAGAGTTCGAGAAA | 90136305 (*Bicyclus anynana*)<br>78230577 (*Heliconius erato/himera* mixed EST library)<br>60312108 (*Papilio dardanus*) |
| CS011 | 1846 | TTGACTGGAGAGTTCGAGAAAA | 86465126 (*Bombyx mori*)<br>110262261 (*Spodoptera frugiperda*) |

TABLE 4-CS-continued

| Target ID | SEQ ID NO | Sequence * | Example Gi-number and species |
|---|---|---|---|
| CS011 | 1847 | TGGGATACTGCTGGCCAAGAA | 21639295 (*Sarcoptes scabiei*) |
| CS013 | 1848 | GATCCCATTCAGTCTGTCAAGGG | 3626535 (*Drosophila melanogaster*) |
| CS013 | 1849 | TTCCAAGCAAAGATGTTGGATATGTTGAA | 112433067 (*Myzus persicae*) |
| CS014 | 1850 | AAAAAGATCCAATCTTCGAACATGCTGAA | 103775905 (*Heliconius erato*) |
| CS014 | 1851 | AAACAAGTGGAACTCCAGAAAAA | 101403826 (*Plodia interpunctella*) |
| CS014 | 1852 | AAAGTGCGTGAGGACCACGTACG | 87266590 (*Choristoneura fumiferana*) 3738660 (*Manduca sexta*) |
| CS014 | 1853 | AAGATCAGCAACACTCTGGAGTC | 58371699 (*Lonomia obliqua*) |
| CS014 | 1854 | AAGATCAGCAACACTCTGGAGTCTCG | 91848497 (*Bombyx mori*) |
| CS014 | 1855 | AAGATCCAATCTTCGAACATG | 77790417 (*Aedes aegypti*) |
| CS014 | 1856 | AAGATCCAATCTTCGAACATGCTGAA | 91756466 (*Bombyx mori*) |
| CS014 | 1857 | AAGCAGATCAAGCATATGATGGCCTTCATCGAACA | 90814338 (*Nasonia vitripennis*) |
| CS014 | 1858 | AAGCAGATCAAGCATATGATGGCCTTCATCGAACAAGAGGC | 87266590 (*Choristoneura fumiferana*) |
| CS014 | 1859 | ATGATGGCCTTCATCGAACAAGA | 111158385 (*Myzus persicae*) |
| CS014 | 1860 | ATGATGGCCTTCATCGAACAAGAGGC | 98993392 (*Antheraea mylitta*) 91756466 (*Bombyx mori*) 103775905 (*Heliconius erato*) |
| CS014 | 1861 | CAGATCAAGCATATGATGGCCTTCATCGA | 53884266 (*Plutella xylostella*) |
| CS014 | 1862 | CAGCAGCGGCTCAAGATCATGGAATACTA | 101403826 (*Plodia interpunctella*) |
| CS014 | 1863 | CATATGATGGCCTTCATCGAACAAGAGGC | 101403826 (*Plodia interpunctella*) |
| CS014 | 1864 | CTCAAAGTGCGTGAGGACCACGT | 103775905 (*Heliconius erato*) |
| CS014 | 1865 | CTCAAGATCATGGAATACTACGA | 15068660 (*Drosophila melanogaster*) |
| CS014 | 1866 | GAAATCGATGCAAAGGCCGAAGAGGAGTTCAA | 103775905 (*Heliconius erato*) |
| CS014 | 1867 | GAACTCCAGAAAAAGATCCAATC | 76551032 (*Spodoptera frugiperda*) |
| CS014 | 1868 | GAACTCCAGAAAAAGATCCAATCTTCGAACATGCTGAA | 87266590 (*Choristoneura fumiferana*) |
| CS014 | 1869 | GAGGAAATCGATGCAAAGGCCGA | 76551032 (*Spodoptera frugiperda*) |
| CS014 | 1870 | GCCGAAGAGGAGTTCAACATTGAAAAAGG | 33374540 (*Glossina morsitans*) |
| CS014 | 1871 | GCGCCTGGCTGAGGTGCCCAA | 101403826 (*Plodia interpunctella*) |
| CS014 | 1872 | GGCCGCCTGGTGCAGCAGCAGCG | 24975647 (*Anopheles gambiae*) |
| CS014 | 1873 | GGCTCAAGATCATGGAATACTA | 37593557 (*Pediculus humanus*) |
| CS014 | 1874 | GGCTCAAGATCATGGAATACTACGA | 58371699 (*Lonomia obliqua*) |
| CS014 | 1875 | TACGAAAAGAAAGAGAAACAAGT | 33374540 (*Glossina morsitans*) |
| CS014 | 1876 | TGAAGGTGCTCAAAGTGCGTGAGGA | 92976185 (*Drosophila grimshawi*) 92994742 (*Drosophila mojavensis*) |
| CS014 | 1877 | TTCAAAAGCAGATCAAGCATATGATGGCCTTCATCGAACAAGAGGC | 3738660 (*Manduca sexta*) |
| CS015 | 1878 | AACGGGCCGGAGATCATGTCCAA | 92480997 (*Drosophila erecta*) |
| CS015 | 1879 | AACTGCCCCGATGAGAAGATCCG | 91086234 (*Tribolium castaneum*) |
| CS015 | 1880 | ATCTTCATCGATGAACTGGATGC | 56152379 (*Rhynchosciara americana*) |
| CS015 | 1881 | CATATATTGCCCATTGATGATTC | 58371642 (*Lonomia obliqua*) |

TABLE 4-CS-continued

| Target ID | SEQ ID NO | Sequence * | Example Gi-number and species |
|---|---|---|---|
| CS015 | 1882 | CTCATGTATGGGCCGCCTGGTACCGG | 83423460 (Bombyx mori) |
| CS015 | 1883 | CTGCCCCGATGAGAAGATCCGCATGAACCG | 92948836 (Drosophila ananassae) |
| CS015 | 1884 | GAGAAGATCCGCATGAACCGCGT | 4691131 (Aedes aegypti)<br>92466521 (Drosophila erecta)<br>15070638 (Drosophila melanogaster) |
| CS015 | 1885 | GTACATATATTGCCCATTGAT | 90133859 (Bicyclus anynana) |
| CS015 | 1886 | TCATCGCACGTGATCGTAATGGC | 22474136 (Helicoverpa armigera) |
| CS015 | 1887 | TTCATGGTTCGCGGGGCATG | 29551125 (Bombyx mori) |
| CS016 | 1888 | AAATCGGTGTACATGTAACCTGGGAAACCACG | 55797015 (Acyrthosiphon pisum)<br>73615307 (Aphis gossypii) |
| CS016 | 1889 | AAGTTGTCCTCGTGGTCGTCCA | 91826756 (Bombyx mori) |
| CS016 | 1890 | ACAGATCTGGGCGGCAATTTC | 18950388 (Anopheles gambiae)<br>31206154 (Anopheles gambiae str. PEST) |
| CS016 | 1891 | ACAGCCTTCATGGCCTGCACGTCCTT | 76169888 (Diploptera punctata)<br>92953069 (Drosophila ananassae)<br>92477149 (Drosophila erecta)<br>8809 (Drosophila melanogaster)<br>55694467 (Drosophila yakuba) |
| CS016 | 1892 | ACATCAGAGTGGTCCTTGCGGGTCAT | 55694467 (Drosophila yakuba)<br>110248186 (Spodoptera frugiperda) |
| CS016 | 1893 | ACCAGCACGTGTTTCTCACACTGGTA | 91829127 (Bombyx mori) |
| CS016 | 1894 | ACCTCCTCACGGGCGGCGGACAC | 237458 (Heliothis virescens)<br>27372076 (Spodoptera littoralis) |
| CS016 | 1895 | ACGACAGCCTTCATGGCCTGCACGTCCTT | 67896654 (Drosophila pseudoobscura) |
| CS016 | 1896 | ACGTAGATCTGTCCCTCAGTGATGTA | 53883819 (Plutella xylostella) |
| CS016 | 1897 | AGAGCCTCCGCGTACGAAGACATGTC | 53883819 (Plutella xylostella) |
| CS016 | 1898 | AGCAATGGAGTTCATCACGTC | 60295607 (Homalodisca coagulata) |
| CS016 | 1899 | AGCAGCTGCCAGCCGATGTCCAG | 92953069 (Drosophila ananassae)<br>92477149 (Drosophila erecta)<br>55694467 (Drosophila yakuba)<br>112349870 (Helicoverpa armigera)<br>237458 (Heliothis virescens)<br>9713 (Manduca sexta)<br>110242332 (Spodoptera frugiperda) |
| CS016 | 1900 | AGCATCTCCTTGGGGAAGATACG | 63005818 (Bombyx mori)<br>92967975 (Drosophila mojavensis)<br>92938364 (Drosophila virilis)<br>92231646 (Drosophila willistoni)<br>237458 (Heliothis virescens) |
| CS016 | 1901 | AGGGCTTCCTCACCGACGACAGCCTTCATGGCCTG | 4680479 (Aedes aegypti) |
| CS016 | 1902 | ATACCAGTCTGGATCATTTCCTCAGG | 60295607 (Homalodisca coagulata) |
| CS016 | 1903 | ATACGGGACCAGGGGTTGATGGGCTG | 92953552 (Drosophila ananassae) |
| CS016 | 1904 | ATAGCGGAGATACCAGTCTGGATCAT | 237458 (Heliothis virescens)<br>76554661 (Spodoptera frugiperda) |
| CS016 | 1905 | ATCTGGGCGGCAATTTCGTTGTG | 83937869 (Lutzomyia longipalpis) |
| CS016 | 1906 | ATGGCAGACTTCATGAGACGA | 55894053 (Locusta migratoria) |
| CS016 | 1907 | ATGGTGGCCAAATCGGTGTACATGTAACC | 92965644 (Drosophila grimshawi) |
| CS016 | 1908 | ATGGTGGCCAAATCGGTGTACATGTAACCT | 92969578 (Drosophila grimshawi) |

TABLE 4-CS-continued

| Target ID | SEQ ID NO | Sequence * | Example Gi-number and species |
|---|---|---|---|
| CS016 | 1909 | ATGGTGGCCAAATCGGTGTACATGTAACCTGG GAAACCACG | 92231646 (*Drosophila willistoni*) |
| CS016 | 1910 | ATTCAAGAACAGGCACACGTTCTCCATGGAGCC GTTCTCCTCGAAGTCCTGCTTGAAGAA | 67841091 (*Drosophila pseudoobscura*) |
| CS016 | 1911 | ATTGGGGGACCTTTGTCAATGGGTTTTCC | 49395165 (*Drosophila melanogaster*) 99009492 (*Leptinotarsa decemlineata*) |
| CS016 | 1912 | CACACGTTCTCCATGGAGCCGTTCTCCTCGAAG TCCTGCTTGAAGAA | 92477818 (*Drosophila erecta*) |
| CS016 | 1913 | CACTGGTAGGCCAAGAACTCAGC | 4680479 (*Aedes aegypti*) |
| CS016 | 1914 | CATCTCCTTGGGGAAGATACG | 16899457 (*Ctenocephalides felis*) 9713 (*Manduca sexta*) |
| CS016 | 1915 | CCCTCACCGATGGCAGACTTCAT | 4680479 (*Aedes aegypti*) 92924977 (*Drosophila virilis*) 110248186 (*Spodoptera frugiperda*) |
| CS016 | 1916 | CCGATGGCAGACTTCATGAGACG | 71049259 (*Oncometopia nigricans*) |
| CS016 | 1917 | CCGTCTCCATGTTCACACCCATGGCGGCGAAC ACGATGGC | 33547658 (*Anopheles gambiae*) |
| CS016 | 1918 | CCGTTCTCCTCGAAGTCCTGCTTGAAGAA | 31206154 (*Anopheles gambiae* str. PEST) 8809 (*Drosophila melanogaster*) |
| CS016 | 1919 | CCGTTCTCCTCGAAGTCCTGCTTGAAGAACC | 101403557 (*Plodia interpunctella*) |
| CS016 | 1920 | CGAGCAATGGAGTTCATCACGTCGATAGCGGA GATACCAGTCTGGATCAT | 27372076 (*Spodoptera littoralis*) |
| CS016 | 1921 | CGGGCCGTCTCCATGTTCACACCCATGGCGGC GAACACGATGGC | 31206154 (*Anopheles gambiae* str. PEST) |
| CS016 | 1922 | CGTCCGGGCACCTCCTCACGGGCGGC | 18883474 (*Anopheles gambiae*) 31206154 (*Anopheles gambiae* str. PEST) |
| CS016 | 1923 | CGTCCGGGCACCTCCTCACGGGCGGCGGACA C | 9713 (*Manduca sexta*) 110248186 (*Spodoptera frugiperda*) |
| CS016 | 1924 | CTACAGATCTGGGCGGCAATTTC | 91826756 (*Bombyx mori*) 9713 (*Manduca sexta*) 27372076 (*Spodoptera littoralis*) |
| CS016 | 1925 | CTACAGATCTGGGCGGCAATTTCGTTGTG | 237458 (*Heliothis virescens*) 76554661 (*Spodoptera frugiperda*) |
| CS016 | 1926 | CTCGTAGATGGTGGCCAAATC | 53883819 (*Plutella xylostella*) |
| CS016 | 1927 | CTCGTAGATGGTGGCCAAATCGGTGTACATGTA | 18883474 (*Anopheles gambiae*) 31206154 (*Anopheles gambiae* str. PEST) |
| CS016 | 1928 | CTCGTAGATGGTGGCCAAATCGGTGTACATGTA ACC | 92953069 (*Drosophila ananassae*) 92477818 (*Drosophila erecta*) 8809 (*Drosophila melanogaster*) 67896654 (*Drosophila pseudoobscura*) |
| CS016 | 1929 | CTCGTAGATGGTGGCCAAATCGGTGTACATGTA ACCTGGGAAACCACG | 9713 (*Manduca sexta*) 110248186 (*Spodoptera frugiperda*) 27372076 (*Spodoptera littoralis*) |
| CS016 | 1930 | GAACAGGCACACGTTCTCCATGGA | 92962756 (*Drosophila ananassae*) |
| CS016 | 1931 | GACTCGAATACTGTGCGGTTCTCGTAGTT | 87266757 (*Choristoneura fumiferana*) 9713 (*Manduca sexta*) |
| CS016 | 1932 | GACTTCATGAGACGAGACAGGGAAGGCAGCAC GTT | 9713 (*Manduca sexta*) |
| CS016 | 1933 | GAGATACCAGTCTGGATCATTTC | 92969748 (*Drosophila mojavensis*) |
| CS016 | 1934 | GAGATACCAGTCTGGATCATTTCCTC | 92935139 (*Drosophila virilis*) |
| CS016 | 1935 | GATGAAGTTCTTCTCGAACTTGG | 2921501 (*Culex pipiens*) |

TABLE 4-CS-continued

| Target ID | SEQ ID NO | Sequence * | Example Gi-number and species |
|---|---|---|---|
| CS016 | 1936 | GATGAAGTTCTTCTCGAACTTGGT | 4680479 (*Aedes aegypti*)<br>31206154 (*Anopheles gambiae* str. PEST)<br>92953069 (*Drosophila ananassae*)<br>92477149 (*Drosophila erecta*)<br>8809 (*Drosophila melanogaster*)<br>67896654 (*Drosophila pseudoobscura*)<br>55694467 (*Drosophila yakuba*)<br>112349870 (*Helicoverpa armigera*)<br>237458 (*Heliothis virescens*) |
| CS016 | 1937 | GATGAAGTTCTTCTCGAACTTGGTGAGGAACTCGAGGTAGAGCA | 76555122 (*Spodoptera frugiperda*) |
| CS016 | 1938 | GATGGGGATCTGCGTGATGGA | 101403557 (*Plodia interpunctella*)<br>53883819 (*Plutella xylostella*) |
| CS016 | 1939 | GCACACGTTCTCCATGGAGCCGTTCTC | 104530890 (*Belgica antarctica*) |
| CS016 | 1940 | GCCAAATCGGTGTACATGTAACCTGGGAAACCACGTCGTCCGGG | 91829127 (*Bombyx mori*) |
| CS016 | 1941 | GCCAAGAACTCAGCAGCAGTCA | 237458 (*Heliothis virescens*) |
| CS016 | 1942 | GCCGTCTCCATGTTCACACCCA | 83937868 (*Lutzomyia longipalpis*) |
| CS016 | 1943 | GCCGTCTCCATGTTCACACCCAT | 92965644 (*Drosophila grimshawi*) |
| CS016 | 1944 | GCCTGCACGTCCTTACCGATGGCGTAGCA | 112349870 (*Helicoverpa armigera*)<br>237458 (*Heliothis virescens*)<br>110248186 (*Spodoptera frugiperda*) |
| CS016 | 1945 | GCCTTCATGGCCTGCACGTCCTT | 39675733 (*Anopheles gambiae*)<br>31206154 (*Anopheles gambiae* str. PEST) |
| CS016 | 1946 | GCCTTCATGGCCTGCACGTCCTTACCGATGGCGTAGCA | 2921501 (*Culex pipiens*) |
| CS016 | 1947 | GCGGCGAACACGATGGCAAAGTT | 2921501 (*Culex pipiens*)<br>92965644 (*Drosophila grimshawi*) |
| CS016 | 1948 | GCGGCGAACACGATGGCAAAGTTGTCCTCGTG | 77905105 (*Aedes aegypti*) |
| CS016 | 1949 | GCGTACAGCTGGTTGGAAACATC | 67896654 (*Drosophila pseudoobscura*) |
| CS016 | 1950 | GGAATAGGATGGGTGATGTCGTCGTTGGGCATAGT | 110248186 (*Spodoptera frugiperda*) |
| CS016 | 1951 | GGAATAGGATGGGTGATGTCGTCGTTGGGCATAGTCA | 27372076 (*Spodoptera littoralis*) |
| CS016 | 1952 | GGATGGGTGATGTCGTCGTTGGGCAT | 101403557 (*Plodia interpunctella*) |
| CS016 | 1953 | GGCAGACCGGCAGCCGAGAAAATGGGGATCTT | 67841091 (*Drosophila pseudoobscura*) |
| CS016 | 1954 | GGCATAGTCAAGATGGGGATCTG | 92924977 (*Drosophila virilis*) |
| CS016 | 1955 | GGCCGTCTCCATGTTCACACCCATGGC | 101403557 (*Plodia interpunctella*) |
| CS016 | 1956 | GGCGGGTAGATCTGTCTGTTGTG | 2921501 (*Culex pipiens*)<br>92965644 (*Drosophila grimshawi*)<br>92924977 (*Drosophila virilis*) |
| CS016 | 1957 | GGCGGGTAGATCTGTCTGTTGTGGAGCTGACGGTCTACGTAGATCTGTCCCTCAGT | 237458 (*Heliothis virescens*)<br>110248186 (*Spodoptera frugiperda*) |
| CS016 | 1958 | GGGAAGATACGGAGCAGCTGCCA | 60336551 (*Homalodisca coagulata*) |
| CS016 | 1959 | GGGTTGATGGGCTGTCCCTGGATGTCCAA | 76554661 (*Spodoptera frugiperda*)<br>27372076 (*Spodoptera littoralis*) |
| CS016 | 1960 | GGTTTTCCAGAGCCGTTGAATAC | 62238871 (*Diabrotica virgifera*) |
| CS016 | 1961 | GTGATGAAGTTCTTCTCGAACTTGGT | 87266757 (*Choristoneura fumiferana*) |
| CS016 | 1962 | GTGCGGTTCTCGTAGTTGCCCTG | 31206154 (*Anopheles gambiae* str. PEST)<br>92477149 (*Drosophila erecta*) |

TABLE 4-CS-continued

| Target ID | SEQ ID NO | Sequence * | Example Gi-number and species |
|---|---|---|---|
| | | | 8809 (*Drosophila melanogaster*)<br>67896654 (*Drosophila pseudoobscura*)<br>92938364 (*Drosophila virilis*)<br>92231646 (*Drosophila willistoni*)<br>55694467 (*Drosophila yakuba*) |
| CS016 | 1963 | GTGGCCAAATCGGTGTACATGTAACC | 2921501 (*Culex pipiens*)<br>75469507 (*Tribolium castaneum*) |
| CS016 | 1964 | GTGTACATGTAACCTGGGAAACCACG | 101403557 (*Plodia interpunctella*) |
| CS016 | 1965 | GTGTACATGTAACCTGGGAAACCACGTCG | 237458 (*Heliothis virescens*) |
| CS016 | 1966 | GTGTACATGTAACCTGGGAAACCACGTCGTCC GGGCACCTCCTCACGGGCGGC | 53883819 (*Plutella xylostella*) |
| CS016 | 1967 | TCAGAGTGGTCCTTGCGGGTCAT | 237458 (*Heliothis virescens*)<br>9713 (*Manduca sexta*) |
| CS016 | 1968 | TCAGCAAGGATTGGGGGACCTTTGTC | 10763875 (*Manduca sexta*) |
| CS016 | 1969 | TCCTCACCGACGACAGCCTTCATGGCCTG | 92969578 (*Drosophila grimshawi*) |
| CS016 | 1970 | TCCTCAGGGTAGATACGGGACCA | 76554661 (*Spodoptera frugiperda*) |
| CS016 | 1971 | TCCTCAGGGTAGATACGGGACCAGGGGTTGAT GGGCTG | 22474040 (*Helicoverpa armigera*)<br>237458 (*Heliothis virescens*)<br>9713 (*Manduca sexta*) |
| CS016 | 1972 | TCGAAGTCCTGCTTGAAGAACC | 9713 (*Manduca sexta*) |
| CS016 | 1973 | TCGTAGATGGTGGCCAAATCGGTGTACATGTAA CC | 62239897 (*Diabrotica virgifera*) |
| CS016 | 1974 | TCGTAGATGGTGGCCAAATCGGTGTACATGTAA CCTGGGAAACCACG | 4680479 (*Aedes aegypti*) |
| CS016 | 1975 | TCTACGTAGATCTGTCCCTCAGTGATGTA | 101403557 (*Plodia interpunctella*) |
| CS016 | 1976 | TGCACGTCCTTACCGATGGCGTAGCA | 9713 (*Manduca sexta*)<br>75710699 (*Tribolium castaneum*) |
| CS016 | 1977 | TGGGTGATGTCGTCGTTGGGCAT | 53883819 (*Plutella xylostella*) |
| CS016 | 1978 | TGGTAGGCCAAGAACTCAGCAGC | 9713 (*Manduca sexta*) |
| CS016 | 1979 | TTCAAGAACAGGCACACGTTCTCCAT | 18883474 (*Anopheles gambiae*)<br>31206154 (*Anopheles gambiae* str. PEST)<br>92933153 (*Drosophila virilis*)<br>27372076 (*Spodoptera littoralis*) |
| CS016 | 1980 | TTCAAGAACAGGCACACGTTCTCCATGGA | 92950254 (*Drosophila ananassae*)<br>76554661 (*Spodoptera frugiperda*) |
| CS016 | 1981 | TTCTCACACTGGTAGGCCAAGAA | 18883474 (*Anopheles gambiae*) |
| CS016 | 1982 | TTCTCCTCGAAGTCCTGCTTGAAGAA | 83937868 (*Lutzomyia longipalpis*) |
| CS016 | 1983 | TTGAGCATCTCCTTGGGGAAGATACG | 92477149 (*Drosophila erecta*)<br>8809 (*Drosophila melanogaster*)<br>67896654 (*Drosophila pseudoobscura*)<br>112349870 (*Helicoverpa armigera*) |
| CS016 | 1984 | TTGAGCATCTCCTTGGGGAAGATACGGAGCA | 83928466 (*Lutzomyia longipalpis*) |
| CS016 | 1985 | TTGAGCATCTCCTTGGGGAAGATACGGAGCAG CTGCCA | 50559098 (*Homalodisca coagulata*)<br>71049259 (*Oncometopia nigricans*) |
| CS016 | 1986 | TTGAGCATCTCCTTGGGGAAGATACGGAGCAG CTGCCAGCCGATGTC | 87266757 (*Choristoneura fumiferana*) |
| CS018 | 1987 | TCCGACTACTCTTCCACGGAC | 31659029 (*Anopheles gambiae*) |

TABLE 4-PX

| Target ID | SEQ ID NO | Sequence * | Example Gi-number and species |
|---|---|---|---|
| PX001 | 2120 | AACAACGTGTTCATCATCGGCAAGGGCACGAA | 112350001 (*Helicoverpa armigera*) |
| PX001 | 2121 | AACGTGTTCATCATCGGCAAG | 27562760 (*Anopheles gambiae*)<br>58378595 (*Anopheles gambiae* str. PEST) |
| PX001 | 2122 | AACGTGTTCATCATCGGCAAGG | 42764924 (*Armigeres subalbatus*) |
| PX001 | 2123 | AACGTGTTCATCATCGGCAAGGG | 71048604 (*Oncometopia nigricans*) |
| PX001 | 2124 | AACGTGTTCATCATCGGCAAGGGCACGAA | 112783858 (*Anopheles funestus*) |
| PX001 | 2125 | AACTTGGGGCGAGTGGGCACCATCGTGTC | 90132259 (*Bicyclus anynana*) |
| PX001 | 2126 | AACTTGGGGCGAGTGGGCACCATCGTGTCCCGCGAG | 112350001 (*Helicoverpa armigera*) |
| PX001 | 2127 | AAGATCGTGAAGCAGCGCCTCATCAAGGTGGACGGCAAGGT | 112350001 (*Helicoverpa armigera*) |
| PX001 | 2128 | AAGGTCCGCACCGACCCCACCTA | 14627585 (*Drosophila melanogaster*) |
| PX001 | 2129 | AAGTACAAGCTGTGCAAGGTG | 5498893 (*Antheraea yamamai*)<br>90132259 (*Bicyclus anynana*)<br>92969396 (*Drosophila grimshawi*)<br>50818668 (*Heliconius melpomene*)<br>58371410 (*Lonomia obliqua*) |
| PX001 | 2130 | ACAACGTGTTCATCATCGGCAAGGGCACGAA | 103783745 (*Heliconius erato*) |
| PX001 | 2131 | ACGGCAAGGTCCGCACCGACCC | 77890923 (*Aedes aegypti*) |
| PX001 | 2132 | ACGGCCGCACGCTGCGCTACCCCGACCCGCTCATCAAGGTCAACGACTCC | 101413238 (*Plodia interpunctella*) |
| PX001 | 2133 | ACGTGTTCATCATCGGCAAGGGCAC | 109509107 (*Culex pipiens*) |
| PX001 | 2134 | AGGAGGCCAAGTACAAGCTGT | 27566312 (*Anopheles gambiae*)<br>67889891 (*Drosophila pseudoobscura*) |
| PX001 | 2135 | AGGAGGCCAAGTACAAGCTGTGCAAGGT | 92944919 (*Drosophila ananassae*)<br>67886177 (*Drosophila pseudoobscura*)<br>92045792 (*Drosophila willistoni*) |
| PX001 | 2136 | AGGAGGCCAAGTACAAGCTGTGCAAGGTG | 92929731 (*Drosophila virilis*) |
| PX001 | 2137 | CAACGTGTTCATCATCGGCAA | 109509107 (*Culex pipiens*) |
| PX001 | 2138 | CAACGTGTTCATCATCGGCAAGGGCA | 55816641 (*Drosophila yakuba*) |
| PX001 | 2139 | CACACCTTCGCCACCAGGTTGAACAACGTGTT | 3986403 (*Antheraea yamamai*) |
| PX001 | 2140 | CCCCAAGAAGCATTTGAAGCG | 2886669 (*Drosophila melanogaster*) |
| PX001 | 2141 | CCGAGGAGGCCAAGTACAAGCT | 92944919 (*Drosophila ananassae*) |
| PX001 | 2142 | CCGAGGAGGCCAAGTACAAGCTGTGCAAGGT | 15480750 (*Drosophila melanogaster*) |
| PX001 | 2143 | CCGCACAAGCTGCGCGAGTGCCTGCCGCT | 22474232 (*Helicoverpa armigera*) |
| PX001 | 2144 | CGACGGGCCCAAGAACGTGCC | 112350001 (*Helicoverpa armigera*) |
| PX001 | 2145 | CGAGGAGGCCAAGTACAAGCT | 58378595 (*Anopheles gambiae* str. PEST) |
| PX001 | 2146 | CGAGGAGGCCAAGTACAAGCTG | 18914191 (*Anopheles gambiae*) |
| PX001 | 2147 | CGAGTGGGCACCATCGTGTCCCGCGAG | 3986403 (*Antheraea yamamai*) |
| PX001 | 2148 | CGCTACCCCGACCCGCTCATCAAGGTCAACGACTCC | 112350001 (*Helicoverpa armigera*) |
| PX001 | 2149 | CGCTTCACCATCCACCGCATCAC | 103783745 (*Heliconius erato*) |
| PX001 | 2150 | CGGCAACGAGGTGCTGAAGATCGT | 90132259 (*Bicyclus anynana*) |
| PX001 | 2151 | CGTAACTTGGGGCGAGTGGGCAC | 60311985 (*Papilio dardanus*) |
| PX001 | 2152 | CTACCCGGCTGGATTCATGGATGT | 42764924 (*Armigeres subalbatus*) |
| PX001 | 2153 | CTCATCAAGGTCAACGACTCC | 103783745 (*Heliconius erato*) |

TABLE 4-PX-continued

| Target ID | SEQ ID NO | Sequence * | Example Gi-number and species |
|---|---|---|---|
| PX001 | 2154 | CTCATCAAGGTCAACGACTCCATCCAGCTCGACAT | 3738704 (*Manduca sexta*) |
| PX001 | 2155 | GACGGCAAGGTCCGCACCGAC | 109509107 (*Culex pipiens*) |
| PX001 | 2156 | GACGGCAAGGTCCGCACCGACCC | 77759638 (*Aedes aegypti*) |
| PX001 | 2157 | GAGGAGGCCAAGTACAAGCTGTGCAAGGT | 67841491 (*Drosophila pseudoobscura*) |
| PX001 | 2158 | GAGGAGGCCAAGTACAAGCTGTGCAAGGTG | 56772971 (*Drosophila virilis*) |
| PX001 | 2159 | GAGGCCAAGTACAAGCTGTGCAA | 112350001 (*Helicoverpa armigera*) |
| PX001 | 2160 | GAGGCCAAGTACAAGCTGTGCAAGGTG | 98993531 (*Antheraea mylitta*) |
| PX001 | 2161 | GCCAAGTACAAGCTGTGCAAGGT | 67838306 (*Drosophila pseudoobscura*) <br> 109978109 (*Gryllus pennsylvanicus*) |
| PX001 | 2162 | GCCCCAAGAAGCATTTGAAGCG | 2151718 (*Drosophila melanogaster*) |
| PX001 | 2163 | GCGCGTGGCGACGGGCCCCAA | 5498893 (*Antheraea yamamai*) |
| PX001 | 2164 | GCGCGTGGCGACGGGCCCCAAG | 3986403 (*Antheraea yamamai*) |
| PX001 | 2165 | GGAGGCCAAGTACAAGCTGTGCAAGGT | 92942537 (*Drosophila ananassae*) |
| PX001 | 2166 | GGCCCCAAGAAGCATTTGAAGCG | 4459798 (*Drosophila melanogaster*) |
| PX001 | 2167 | GGCGGCGTGTACGCGCCGCGGCCC | 98994282 (*Antheraea mylitta*) |
| PX001 | 2168 | GTCCGCACCGACCCCACCTACCC | 92472430 (*Drosophila erecta*) <br> 55854272 (*Drosophila yakuba*) |
| PX001 | 2169 | GTGGGCACCATCGTGTCCCGCGAGAG | 3953837 (*Bombyx mandarina*) <br> 29554802 (*Bombyx mori*) |
| PX001 | 2170 | TCAAGGTGGACGGCAAGGTCCGCACCGACCC | 92944919 (*Drosophila ananassae*) |
| PX001 | 2171 | TGATCTACGATGTGAAGGGACG | 83935965 (*Lutzomyia longipalpis*) |
| PX001 | 2172 | TTCATGGATGTTGTGTCGATTGAAAA | 90132259 (*Bicyclus anynana*) |
| PX001 | 2173 | GCTGGATTCATGGATGTTGTG | 10707240 (*Amblyomma americanum*) |
| PX001 | 2174 | AAGCAGCGCCTCATCAAGGTGGACGGCAAGGTCCGCACCGAC | 49545866 (*Rhipicephalus appendiculatus*) |
| PX009 | 2175 | AACATCTTCAACTGTGACTTC | 93001544 (*Drosophila mojavensis*) |
| PX009 | 2176 | TGATCAACATCGAGTGCAAAGC | 110755556 (*Apis mellifera*) |
| PX009 | 2177 | TTCTTGAAGCTGAATAAGATCT | 103750396 (*Drosophila melanogaster*) |
| PX010 | 2178 | CAGTTCCTGCAGGTCTTCAACAA | 71553175 (*Oncometopia nigricans*) |
| PX010 | 2179 | CCATCAGCGGACGGTGGCGCCCCGTG | 90139187 (*Spodoptera frugiperda*) |
| PX010 | 2180 | CCCGCAGTTCATGTACCACCTGCGCCGCTCGCAGTTC | 67893194 (*Drosophila pseudoobscura*) |
| PX010 | 2181 | CCGAACAGCTTCCGTCTGTCGGAGAACTTCAG | 29558345 (*Bombyx mori*) |
| PX010 | 2182 | CGCCTGTGCCAGAAGTTCGGCGAGTACG | 58395529 (*Anopheles gambiae* str. PEST) |
| PX010 | 2183 | CTGCGCCGCTCGCAGTTCCTGCAGGT | 18872210 (*Anopheles gambiae*) |
| PX010 | 2184 | CTGTACCCGCAGTTCATGTACCA | 29558345 (*Bombyx mori*) |
| PX010 | 2185 | GACGTGCTGCGCTGGCTCGACCG | 29558345 (*Bombyx mori*) |
| PX010 | 2186 | GACGTGTCGCTGCAAGTGTTCATGGAGCA | 18872210 (*Anopheles gambiae*) |
| PX010 | 2187 | GAGTACGAGAACTTCAAGCAGCTGCTGC | 77886140 (*Aedes aegypti*) <br> 18872210 (*Anopheles gambiae*) <br> 49376735 (*Drosophila melanogaster*) <br> 67893324 (*Drosophila pseudoobscura*) |
| PX010 | 2188 | GGCGGGGCGATGCCGATACCATC | 91757875 (*Bombyx mori*) |

TABLE 4-PX-continued

| Target ID | SEQ ID NO | Sequence * | Example Gi-number and species |
|---|---|---|---|
| PX010 | 2189 | GTGGCTGCATACAGTTCATTACGCAGTACCAGCAC | 28571527 (*Drosophila melanogaster*) |
| PX010 | 2190 | TCGCAGTTCCTGCAGGTCTTCAACAA | 92932090 (*Drosophila virilis*) |
| PX010 | 2191 | TGCGCCGCTCGCAGTTCCTGCAGGTCTTCAACAA | 67893324 (*Drosophila pseudoobscura*) |
| PX010 | 2192 | TGCGCCGCTCGCAGTTCCTGCAGGTCTTCAACAACTCGCCCGACGAGACCAC | 92952825 (*Drosophila ananassae*) |
| PX010 | 2193 | TTCATGTACCACCTGCGCCGCTCGCAGTTCCTGCAGGTCTTCAACAACTCGCCCGACGAGACCAC | 28571527 (*Drosophila melanogaster*) |
| PX010 | 2194 | ATCCTGCTCATGGACACCTTCTTCCA | 82842646 (*Boophilus microplus*) |
| PX015 | 2195 | CACCGCGACGACACGTTCATGGTGCGCGGCGG | 58371643 (*Lonomia obliqua*) |
| PX015 | 2196 | CAGATCAAGGAGATGGTGGAG | 92480997 (*Drosophila erecta*)<br>58371722 (*Lonomia obliqua*) |
| PX015 | 2197 | CCCGACGAGAAGATCCGCATGAA | 67873606 (*Drosophila pseudoobscura*) |
| PX015 | 2198 | CCCGACGAGAAGATCCGCATGAACCGCGT | 15070733 (*Drosophila melanogaster*) |
| PX015 | 2199 | CCGACGAGAAGATCCGCATGAACCGCGT | 92459970 (*Drosophila erecta*) |
| PX015 | 2200 | CGCAAGGAGACCGTGTGCATTGTGCT | 67873606 (*Drosophila pseudoobscura*) |
| PX015 | 2201 | GACGAGAAGATCCGCATGAACCG | 18914444 (*Anopheles gambiae*) |
| PX015 | 2202 | GACGAGAAGATCCGCATGAACCGCGT | 4691131 (*Aedes aegypti*) |
| PX015 | 2203 | GCGCAGATCAAGGAGATGGTGGAGCT | 99007898 (*Leptinotarsa decemlineata*) |
| PX015 | 2204 | GGCATGCGCGCCGTCGAGTTC | 6901917 (*Bombyx mori*) |
| PX015 | 2205 | GTGCGCGGCGGCATGCGCGCC | 67891252 (*Drosophila pseudoobscura*) |
| PX015 | 2206 | TCAAGGAGATGGTGGAGCTGC | 27819993 (*Drosophila melanogaster*) |
| PX015 | 2207 | TGAAGCCGTACTTCATGGAGGC | 29559940 (*Bombyx mori*) |
| PX015 | 2208 | TGCCGCAAGCAGCTGGCGCAGATCAAGGAGATGGT | 18914444 (*Anopheles gambiae*) |
| PX015 | 2209 | TGGAGGCGTACCGGCCCATCCAC | 18914444 (*Anopheles gambiae*) |
| PX016 | 2210 | AAGGACCACTCCGACGTGTCCAA | 101406307 (*Plodia interpunctella*) |
| PX016 | 2211 | AAGGACGTGCAGGCGATGAAGGC | 112349870 (*Helicoverpa armigera*)<br>110248186 (*Spodoptera frugiperda*) |
| PX016 | 2212 | ACCAAGTTCGAGAAGAACTTCATC | 4680479 (*Aedes aegypti*)<br>31206154 (*Anopheles gambiae* str. PEST)<br>92953069 (*Drosophila ananassae*)<br>92477149 (*Drosophila erecta*)<br>24646340 (*Drosophila melanogaster*)<br>67900295 (*Drosophila pseudoobscura*)<br>55694467 (*Drosophila yakuba*)<br>112349870 (*Helicoverpa armigera*)<br>237458 (*Heliothis virescens*) |
| PX016 | 2213 | ACCAAGTTCGAGAAGAACTTCATCAC | 87266757 (*Choristoneura fumiferana*) |
| PX016 | 2214 | ACCGCCAGGTTCTTCAAGCAGGACTTCGA | 9713 (*Manduca sexta*) |
| PX016 | 2215 | ACCGGCGATATTCTGCGCACGCCCGTCTC | 92940287 (*Drosophila virilis*) |
| PX016 | 2216 | AGCAGGACTTCGAGGAGAACGG | 67880606 (*Drosophila pseudoobscura*) |
| PX016 | 2217 | ATCACGCAGATCCCCATCCTGACCATGCC | 31206154 (*Anopheles gambiae* str. PEST) |
| PX016 | 2218 | ATCTTGACCGACATGTCTTCATACGC | 104530890 (*Belgica antarctica*)<br>92231646 (*Drosophila willistoni*) |
| PX016 | 2219 | ATGACCAGGAAGGACCACTCCGACGT | 75713096 (*Tribolium castaneum*) |
| PX016 | 2220 | ATGCCCAACGACGACATCACCCA | 101406307 (*Plodia interpunctella*)<br>76555122 (*Spodoptera frugiperda*)<br>27372076 (*Spodoptera littoralis*) |

TABLE 4-PX-continued

| Target ID | SEQ ID NO | Sequence * | Example Gi-number and species |
|---|---|---|---|
| PX016 | 2221 | CAGAAGATCCCCATCTTCTCCGCCGCCGGTCTGCCCCACAACGA | 92460896 (*Drosophila erecta*)<br>24646340 (*Drosophila melanogaster*) |
| PX016 | 2222 | CAGGACTTCGAGGAGAACGGTTCCATGGAGAACGT | 2921501 (*Culex pipiens*)<br>76554661 (*Spodoptera frugiperda*) |
| PX016 | 2223 | CCAAGTTCGAGAAGAACTTCATC | 2921501 (*Culex pipiens*) |
| PX016 | 2224 | CCCATCAACCCGTGGTCCCGTATCTACCCGGAGGA | 2921501 (*Culex pipiens*) |
| PX016 | 2225 | CCCGACTTGACCGGGTACATCACTGAGGGACAGATCTACGT | 101406307 (*Plodia interpunctella*) |
| PX016 | 2226 | CCCGGACGACGTGGTTTCCCAGGTTACATGTACAC | 91829127 (*Bombyx mori*) |
| PX016 | 2227 | CCTGGACATCCAGGGGCAGCCCATCAACCC | 91090030 (*Tribolium castaneum*) |
| PX016 | 2228 | CGACGTGGTTTCCCAGGTTACATGTACACGGATTTGGC | 237458 (*Heliothis virescens*) |
| PX016 | 2229 | CGTCTCATGAAGTCCGCCATCGG | 91829127 (*Bombyx mori*) |
| PX016 | 2230 | CGTCTCATGAAGTCCGCCATCGGAGAGGGCATGACC | 237458 (*Heliothis virescens*) |
| PX016 | 2231 | CGTGGTCAGAAGATCCCCATCTTCTC | 27372076 (*Spodoptera littoralis*) |
| PX016 | 2232 | CGTGGTCAGAAGATCCCCATCTTCTCCGC | 76554661 (*Spodoptera frugiperda*) |
| PX016 | 2233 | CGTGGTTTCCCAGGTTACATGTACAC | 55797015 (*Acyrthosiphon pisum*)<br>4680479 (*Aedes aegypti*)<br>73615307 (*Aphis gossypii*)<br>92231646 (*Drosophila willistoni*)<br>9713 (*Manduca sexta*)<br>76555122 (*Spodoptera frugiperda*)<br>27372076 (*Spodoptera littoralis*) |
| PX016 | 2234 | CGTGGTTTCCCAGGTTACATGTACACGGATTTGGCCACAATCTACGAGCGCGCCGGGCG | 101406307 (*Plodia interpunctella*) |
| PX016 | 2235 | CTACGAGAACCGCACAGTGTTCGAGTC | 112350031 (*Helicoverpa armigera*)<br>237458 (*Heliothis virescens*)<br>76555122 (*Spodoptera frugiperda*) |
| PX016 | 2236 | CTGCGTATCTTCCCCAAGGAGAT | 63005818 (*Bombyx mori*)<br>92477149 (*Drosophila erecta*)<br>24646340 (*Drosophila melanogaster*)<br>56773982 (*Drosophila pseudoobscura*)<br>92935600 (*Drosophila virilis*)<br>92220609 (*Drosophila willistoni*)<br>112350031 (*Helicoverpa armigera*)<br>237458 (*Heliothis virescens*)<br>9713 (*Manduca sexta*) |
| PX016 | 2237 | CTGTACGCGTGCTACGCCATCGG | 9713 (*Manduca sexta*) |
| PX016 | 2238 | CTGTTCTTGAACTTGGCCAATGA | 16898595 (*Ctenocephalides felis*) |
| PX016 | 2239 | CTGTTCTTGAACTTGGCCAATGACCC | 27372076 (*Spodoptera littoralis*) |
| PX016 | 2240 | GACAACTTCGCCATCGTGTTCGC | 92950254 (*Drosophila ananassae*) |
| PX016 | 2241 | GACAACTTCGCCATCGTGTTCGCCGC | 92477818 (*Drosophila erecta*)<br>24646340 (*Drosophila melanogaster*)<br>237458 (*Heliothis virescens*)<br>9713 (*Manduca sexta*)<br>76554661 (*Spodoptera frugiperda*) |
| PX016 | 2242 | GACAACTTCGCCATCGTGTTCGCCGCCATGGG | 31206154 (*Anopheles gambiae* str. PEST) |
| PX016 | 2243 | GACCGTCAGCTGCACAACAGGCA | 50564193 (*Homalodisca coagulata*) |
| PX016 | 2244 | GACCTGCTCTACCTCGAGTTC | 112349870 (*Helicoverpa armigera*) |
| PX016 | 2245 | GACGTGATGAACTCCATCGCCCG | 237458 (*Heliothis virescens*) |
| PX016 | 2246 | GACGTGATGAACTCCATCGCCCGTGG | 22474040 (*Helicoverpa armigera*) |
| PX016 | 2247 | GAGAACGGTTCCATGGAGAACGT | 91829127 (*Bombyx mori*) |

TABLE 4-PX-continued

| Target ID | SEQ ID NO | Sequence * | Example Gi-number and species |
|---|---|---|---|
| PX016 | 2248 | GAGGAGATGATCCAGACTGGTATCTCCGCTAT | 237458 (*Heliothis virescens*)<br>76554661 (*Spodoptera frugiperda*) |
| PX016 | 2249 | GAGGAGATGATCCAGACTGGTATCTCCGCTATCGACGTGATGAACTCCAT | 27372076 (*Spodoptera littoralis*) |
| PX016 | 2250 | GAGGAGGCGCTCACGCCCGACGAC | 9713 (*Manduca sexta*) |
| PX016 | 2251 | GAGTTCTTGGCCTACCAGTGCGAGAA | 4680479 (*Aedes aegypti*) |
| PX016 | 2252 | GCCAGGTTCTTCAAGCAGGACTTCGAGGAGAACGG | 101403557 (*Plodia interpunctella*) |
| PX016 | 2253 | GCCCGTGGTCAGAAGATCCCCAT | 67877903 (*Drosophila pseudoobscura*) |
| PX016 | 2254 | GCCCGTGGTCAGAAGATCCCCATCTTCTC | 6901845 (*Bombyx mori*) |
| PX016 | 2255 | GCCCGTGGTCAGAAGATCCCCATCTTCTCCGCCGC | 92950254 (*Drosophila ananassae*) |
| PX016 | 2256 | GCCGAGTTCTTGGCCTACCAGTGCGAGAA | 24646340 (*Drosophila melanogaster*) |
| PX016 | 2257 | GCCGAGTTCTTGGCCTACCAGTGCGAGAAACACGTGTTGGT | 110240379 (*Spodoptera frugiperda*) |
| PX016 | 2258 | GCCGCCCGTGAGGAGGTGCCCGGACG | 31206154 (*Anopheles gambiae* str. PEST)<br>9713 (*Manduca sexta*)<br>110240379 (*Spodoptera frugiperda*) |
| PX016 | 2259 | GCCTACCAGTGCGAGAAACACGTGTTGGTAATCTTGACCGACATGTC | 101406307 (*Plodia interpunctella*) |
| PX016 | 2260 | GGCAGATCTACCCGCCGGTGAA | 31206154 (*Anopheles gambiae* str. PEST) |
| PX016 | 2261 | GGCGAGGAGGCGCTCACGCCCGACGA | 31206154 (*Anopheles gambiae* str. PEST) |
| PX016 | 2262 | GGTCAGAAGATCCCCATCTTCTC | 60295607 (*Homalodisca coagulata*) |
| PX016 | 2263 | GGTTACATGTACACGGATTTGGCCAC | 92924977 (*Drosophila virilis*) |
| PX016 | 2264 | GTGGTGGGCGAGGAGGCGCTCACGCC | 112349870 (*Helicoverpa armigera*) |
| PX016 | 2265 | GTTCACCGGCGATATTCTGCG | 92997483 (*Drosophila grimshawi*) |
| PX016 | 2266 | GTTCACCGGCGATATTCTGCGCAC | 92950254 (*Drosophila ananassae*)<br>92048971 (*Drosophila willistoni*) |
| PX016 | 2267 | TACCAGTGCGAGAAACACGTGTTGGT | 237458 (*Heliothis virescens*) |
| PX016 | 2268 | TACGCCATCGGCAAGGACGTGCAGGCGATGAAGGC | 87266757 (*Choristoneura fumiferana*) |
| PX016 | 2269 | TCCATCACGCAGATCCCCATCCT | 101406307 (*Plodia interpunctella*) |
| PX016 | 2270 | TCCGGCAAGCCCATCGACAAGGG | 92460896 (*Drosophila erecta*)<br>24646340 (*Drosophila melanogaster*)<br>22474040 (*Helicoverpa armigera*)<br>237458 (*Heliothis virescens*) |
| PX016 | 2271 | TCTACGAGCGCGCCGGGCGAGTC | 33528180 (*Trichoplusia ni*) |
| PX016 | 2272 | TCTCGTCTCATGAAGTCCGCCATCGG | 9713 (*Manduca sexta*) |
| PX016 | 2273 | TGACTGCTGCCGAGTTCTTGGCCTACCAGTGCGAGAAACACGTGTTGGT | 27372076 (*Spodoptera littoralis*) |
| PX016 | 2274 | TGCACAACAGGCAGATCTACCC | 62239897 (*Diabrotica virgifera*) |
| PX016 | 2275 | TGCGTATCTTCCCCAAGGAGAT | 16900620 (*Ctenocephalides felis*)<br>92967975 (*Drosophila mojavensis*) |
| PX016 | 2276 | TGCTACGCCATCGGCAAGGACGTGCAGGC | 31206154 (*Anopheles gambiae* str. PEST)<br>92953069 (*Drosophila ananassae*)<br>92477149 (*Drosophila erecta*)<br>24646340 (*Drosophila melanogaster*)<br>67898824 (*Drosophila pseudoobscura*)<br>55694467 (*Drosophila yakuba*) |
| PX016 | 2277 | TGCTCTACCTCGAGTTCCTCACCAAGTTCGAGAAGAACTTCATC | 76555122 (*Spodoptera frugiperda*) |

TABLE 4-PX-continued

| Target ID | SEQ ID NO | Sequence * | Example Gi-number and species |
|---|---|---|---|
| PX016 | 2278 | TGTCTGTTCTTGAACTTGGCCAA | 4680479 (*Aedes aegypti*) 92477818 (*Drosophila erecta*) 24646340 (*Drosophila melanogaster*) |
| PX016 | 2279 | TGTCTGTTCTTGAACTTGGCCAATGA | 55905051 (*Locusta migratoria*) |
| PX016 | 2280 | TGTTCTTGAACTTGGCCAATGA | 91090030 (*Tribolium castaneum*) |
| PX016 | 2281 | TTCAACGGCTCCGGCAAGCCCAT | 76554661 (*Spodoptera frugiperda*) |
| PX016 | 2282 | TTCAACGGCTCCGGCAAGCCCATCGACAAGGG | 4680479 (*Aedes aegypti*) 31206154 (*Anopheles gambiae* str. PEST) 67877903 (*Drosophila pseudoobscura*) |
| PX016 | 2283 | TTCGAGGAGAACGGTTCCATGGAGAA | 92972277 (*Drosophila grimshawi*) |
| PX016 | 2284 | TTCGAGGAGAACGGTTCCATGGAGAACGT | 92950254 (*Drosophila ananassae*) |
| PX016 | 2285 | TTCTTCAAGCAGGACTTCGAGGAGAA | 83937868 (*Lutzomyia longipalpis*) |
| PX016 | 2286 | TTCTTCAAGCAGGACTTCGAGGAGAACGG | 92477818 (*Drosophila erecta*) |
| PX016 | 2287 | TTCTTCAAGCAGGACTTCGAGGAGAACGGTTC | 31206154 (*Anopheles gambiae* str. PEST) |
| PX016 | 2288 | TTCTTCAAGCAGGACTTCGAGGAGAACGGTTCCATGGAGAACGT | 24646340 (*Drosophila melanogaster*) |
| PX016 | 2289 | TTCTTGAACTTGGCCAATGACCC | 9713 (*Manduca sexta*) |
| PX016 | 2290 | TTCTTGGCCTACCAGTGCGAGAA | 31206154 (*Anopheles gambiae* str. PEST) 67883622 (*Drosophila pseudoobscura*) 92231646 (*Drosophila willistoni*) |

TABLE 4-AD

| Target ID | SEQ ID NO | Sequence * | Example Gi-number and species |
|---|---|---|---|
| AD001 | 2384 | AAAGCATGGATGTTGGACAAA | 73619372 (*Aphis gossypii*); 77325485 (*Chironomus tentans*); 22474232 (*Helicoverpa armigera*); 37951951 (*Ips pini*); 60305420 (*Mycetophagus quadripustulatus*); 84647995 (*Myzus persicae*) |
| AD001 | 2385 | AAAGCATGGATGTTGGACAAACT | 94432102 (*Bombyx mori*); 103790417 (*Heliconius erato*); 55904580 (*Locusta migratoria*); 101419954 (*Plodia interpunctella*) |
| AD001 | 2386 | AAAGGTATTCCATTCTTGGTGACCCATGATGGCCGTACTATCCGTTATCCTGACCCAGTCATTAAAGT | 109978109 (*Gryllus pennsylvanicus*) |
| AD001 | 2387 | AACTGTGAAGTAACGAAGATTGTTATGCAGCGACTTATCAAAGTTGA | 109978109 (*Gryllus pennsylvanicus*) |
| AD001 | 2388 | AAGAAGCATTTGAAGCGTTTAAA | 3658572 (*Manduca sexta*) |
| AD001 | 2389 | AAGGGTAAGGGTGTGAAATTGAGTAT | 109978109 (*Gryllus pennsylvanicus*) |
| AD001 | 2390 | AATGTATTCATCATTGGAAAAGC | 55904577 (*Locusta migratoria*) |
| AD001 | 2391 | AGAAGCATTTGAAGCGTTTAAA | 98994282 (*Antheraea mylitta*) 73619372 (*Aphis gossypii*) |
| AD001 | 2392 | AGAAGCATTTGAAGCGTTTAAATGC | 27620566 (*Anopheles gambiae*) |
| AD001 | 2393 | AGTACTGGCCCCCACAAATTGCG | 109978109 (*Gryllus pennsylvanicus*) |
| AD001 | 2394 | AGTGCAGAAGAAGCCAAGTACAAGCT | 109978109 (*Gryllus pennsylvanicus*) |
| AD001 | 2395 | ATCGCCGAGGAGCGGGACAAGC | 3953837 (*Bombyx mandarina*) 94432102 (*Bombyx mori*) |
| AD001 | 2396 | CAAGGACATACTTTTGCCACAAGATTGAATAATGTATTCATCATTGGAAA | 109978109 (*Gryllus pennsylvanicus*) |

TABLE 4-AD-continued

| Target ID | SEQ ID NO | Sequence * | Example Gi-number and species |
|---|---|---|---|
| AD001 | 2397 | CAGAAGAAGCCAAGTACAAGCT | 42764924 (*Armigeres subalbatus*) |
| AD001 | 2398 | CATGATGGCCGTACTATCCGTTA | 73613065 (*Aphis gossypii*) |
| AD001 | 2399 | CATGATGGCCGTACTATCCGTTATCCTGACCC | 31365398 (*Toxoptera citricida*) |
| AD001 | 2400 | CATTTGAAGCGTTTAAATGCTCC | 27557322 (*Anopheles gambiae*) |
| AD001 | 2401 | CCTAAAGCATGGATGTTGGAC | 77324536 (*Chironomus tentans*) |
| AD001 | 2402 | CCTAAAGCATGGATGTTGGACAA | 58371410 (*Lonomia obliqua*) |
| AD001 | 2403 | CCTAAAGCATGGATGTTGGACAAA | 60311985 (*Papilio dardanus*) 30031258 (*Toxoptera citricida*) |
| AD001 | 2404 | CCTAAAGCATGGATGTTGGACAAACT | 98994282 (*Antheraea mylitta*) |
| AD001 | 2405 | CGTACTATCCGTTATCCTGACCC | 37804548 (*Rhopalosiphum padi*) |
| AD001 | 2406 | GAATGTTTACCTTTGGTGATTTTTCTTCGCAATCGGCT | 109978109 (*Gryllus pennsylvanicus*) |
| AD001 | 2407 | GCAGAAGAAGCCAAGTACAAGCT | 37953169 (*Ips pini*) |
| AD001 | 2408 | GCATGGATGTTGGACAAACTCGG | 83935968 (*Lutzomyia longipalpis*) |
| AD001 | 2409 | GCTGGTTTCATGGATGTTGTCAC | 109978109 (*Gryllus pennsylvanicus*) |
| AD001 | 2410 | GGCCCCAAGAAGCATTTGAAGCGTTTAA | 14693528 (*Drosophila melanogaster*) |
| AD001 | 2411 | GGTTTCATGGATGTTGTCACCAT | 25958683 (*Curculio glandium*) |
| AD001 | 2412 | TATGATGTGAAAGGCCGTTTCACAATTCACAGAAT | 109978109 (*Gryllus pennsylvanicus*) |
| AD001 | 2413 | TCATTGCCAAAGGGTAAGGGT | 77324972 (*Chironomus tentans*) |
| AD001 | 2414 | TGGATATTGCCACTTGTAAAATCATGGACCACATCAGATTTGAATCTGG | 109978109 (*Gryllus pennsylvanicus*) |
| AD001 | 2415 | TTAAATGCTCCTAAAGCATGGATGTTGGACAAACT | 109978109 (*Gryllus pennsylvanicus*) |
| AD001 | 2416 | TTTGAATCTGGCAACCTGTGTATGAT | 60311985 (*Papilio dardanus*) |
| AD001 | 2417 | TTTGATATTGTTCATATCAAGGATAC | 109978109 (*Gryllus pennsylvanicus*) |
| AD002 | 2418 | AAGAAAATCGAACAAGAAATC | 55902553 (*Locusta migratoria*) |
| AD002 | 2419 | CAGCACATGGATGTGGACAAGGT | 67899569 (*Drosophila pseudoobscura*) |
| AD002 | 2420 | GAGTTTCTTTAGTAAAGTATTCGGTGG | 110762684 (*Apis mellifera*) |
| AD009 | 2421 | CACTACAACTACCACAAGAGC | 84226228 (*Aedes aegypti*) 18941376 (*Anopheles gambiae*) |
| AD009 | 2422 | CAGAACATCCACAACTGTGACT | 29534871 (*Bombyx mori*) |
| AD009 | 2423 | GGTGTGGGTGTCGTGCGAGGG | 83926368 (*Lutzomyia longipalpis*) |
| AD009 | 2424 | TGGATCCCTGAATACTACAATGA | 83926506 (*Lutzomyia longipalpis*) |
| AD015 | 2425 | GAGCAGTAGAATTCAAAGTAGT | 99012451 (*Leptinotarsa decemlineata*) |
| AD015 | 2426 | GCAATTATATTTATTGATGAA | 83936542 (*Lutzomyia longipalpis*) |
| AD015 | 2427 | TCACCATATTGTATTGTTGCT | 31366806 (*Toxoptera citricida*) |
| AD015 | 2428 | TTGTCCTGATGTTAAGTATGG | 84114691 (*Blomia tropicalis*) |
| AD016 | 2429 | ACGATGCCCAACGACGACATCACCCATCC | 101406307 (*Plodia interpunctella*) |
| AD016 | 2430 | ATGCCCAACGACGACATCACCCA | 53883819 (*Plutella xylostella*) |
| AD016 | 2431 | ATGCCCAACGACGACATCACCCATCCTATT | 110240379 (*Spodoptera frugiperda*) 27372076 (*Spodoptera littoralis*) |

TABLE 4-AD-continued

| Target ID | SEQ ID NO | Sequence * | Example Gi-number and species |
|---|---|---|---|
| AD016 | 2432 | CAGAAGATCCCCATCTTCTCGG | 91827264 (*Bombyx mori*)<br>22474331 (*Helicoverpa armigera*)<br>60295607 (*Homalodisca coagulata*) |
| AD016 | 2433 | CGGCTCCATCACTCAGATCCCAT | 67896654 (*Drosophila pseudoobscura*) |
| AD016 | 2434 | GCCAACGACCCCACCATCGAG | 101406307 (*Plodia interpunctella*) |
| AD016 | 2435 | GCCCGTGTCCGAGGACATGCTGGG | 83937868 (*Lutzomyia longipalpis*)<br>75473525 (*Tribolium castaneum*) |
| AD016 | 2436 | GGCAGAAGATCCCCATCTTCTC | 2286803 (*Drosophila melanogaster*) |
| AD016 | 2437 | GTTCACCGGCGATATTCTGCG | 92997483 (*Drosophila grimshawi*) |
| AD016 | 2438 | GTTCACCGGCGATATTCTGCGC | 92953552 (*Drosophila ananassae*)<br>92042621 (*Drosophila willistoni*) |

TABLE 5-LD

| Target ID | SEQ ID No | Sequences* | Example Gi-number and species |
|---|---|---|---|
| LD001 | 124 | AAGAAGCATTTGAAGCGTTTG | 8005678 (*Meloidogyne incognita*), 9829015 (*Meloidogyne javanica*) |
| LD003 | 125 | GTTCTTCCTCTTGACGCGTCC | 7710484 (*Zeldia punctata*) |
| LD003 | 126 | GCAGCTTTACGGATTTTTGCCAA | 32183696 (*Meloidogyne chitwoodi*) |
| LD003 | 127 | TTTCAACTCCTGATCAAGACGT | 1662318 (*Brugia malayi*), 31229562 (*Wuchereria bancrofti*) |
| LD006 | 128 | GCTATGGGTAAGCAAGCTATGGG | 520506 (*Caenorhabditis elegans*) |
| LD007 | 129 | AAAGAATAAAAAATTATTTGA | 17539725 (*Caenorhabditis elegans*) |
| LD007 | 130 | AAGCAAGTGATGATGTTCAGTGC | 7143515 (*Globodera pallida*) |
| LD014 | 131 | ATGATGGCTTTCATTGAACAAGA | 10122191 (*Haemonchus contortus*) |
| LD015 | 132 | AACGCCCCAGTCTCATTAGCCAC | 20064339 (*Meloidogyne hapla*) |
| LD016 | 133 | TTTTGGCGTCGATTCCTGATG | 71999357 (*Caenorhabditis elegans*) |
| LD016 | 134 | GTGTACATGTAACCTGGGAAACC | 13418283 (*Necator americanus*) |
| LD016 | 135 | GTGTACATGTAACCTGGGAAACCACGACG | 10819046 (*Haemonchus contortus*) |

TABLE 5-PC

| Target ID | SEQ ID NO | Sequence * | Example Gi-number and species |
|---|---|---|---|
| PC001 | 435 | ATGGATGTTGGACAAATTGGG | 7143612 (*Globodera rostochiensis*) |
| PC003 | 436 | GCTAAAATCCGTAAAGCTGCTCGTGAACT | 9831177 (*Strongyloides stercoralis*) |
| PC003 | 437 | GAGTAAAGTACACTTTGGCTAAA | 28914459 (*Haemonchus contortus*) |
| PC003 | 438 | AAAATCCGTAAAGCTGCTCGTGAACT | 32185135 (*Meloidogyne chitwoodi*) |
| PC003 | 439 | CTGGACTCGCAGAAGCACATCGACTT | 51334250 (*Radopholus similis*) |
| PC003 | 440 | CGTCTGGATCAGGAATTGAAA | 61115845 (*Litomosoides sigmodontis*) |
| PC005 | 441 | TGGTTGGATCCAAATGAAATCAA | 5430825 (*Onchocerca volvulus*) |
| PC005 | 442 | GTGTGGTTGGATCCAAATGAAATCAA | 6845701 (*Brugia malayi*); 45215079 (*Wuchereria bancrofti*) |
| PC014 | 443 | CACATGATGGCTTTCATTGAACAAGAAGC | 10122191 (*Haemonchus contortus*) |
| PC014 | 444 | TACGAGAAAAGGAGAAGCAAGT | 21265518 (*Ostertagia ostertagi*) |

TABLE 5-PC-continued

| Target ID | SEQ ID NO | Sequence * | Example Gi-number and species |
|---|---|---|---|
| PC016 | 445 | GTCTGGATCATTTCCTCGGGATAAAT | 18081287 (*Globodera rostochiensis*) |
| PC016 | 446 | CCAGTCTGGATCATTTCCTCGGGATA | 108957716 (*Bursaphelenchus mucronatus*); 108962248 (*Bursaphelenchus xylophilus*) |

TABLE 5-EV

| Target ID | SEQ ID NO | Sequence * | Example Gi-number and species |
|---|---|---|---|
| EV005 | 563 | TTAAAGATGGTCTTATTATTAA | 21819186 (*Trichinella spiralis*) |
| EV016 | 564 | GCTATGGGTGTCAATATGGAAAC | 54554020 (*Xiphinema* index) |

TABLE 5-AG

| Target ID | SEQ ID NO | Sequence * | Example Gi-number and species |
|---|---|---|---|
| AG001 | 739 | GCTGGATTCATGGATGTGATCA | 15666884 (*Ancylostoma ceylanicum*) |
| AG001 | 740 | ATGGATGTTGGACAAATTGGG | 18081843 (*Globodera rostochiensis*) |
| AG001 | 741 | TTCATGGATGTGATCACCATTGA | 27002091 (*Ascaris suum*) |
| AG005 | 742 | GTCTGGTTGGATCCAAATGAAATCAATGA | 2099126 (*Onchocerca volvulus*) |
| AG005 | 743 | GGATCCAAATGAAATCAATGA | 2099309 (*Onchocerca volvulus*) |
| AG005 | 744 | TGATCAAGGATGGTTTGATCAT | 2130916 (*Brugia malayi*) |
| AG005 | 745 | TGGTTGGATCCAAATGAAATCAATGA | 6845701 (*Brugia malayi*) |
| AG005 | 746 | CCAAGGGTAACGTGTTCAAGAACAAG | 29964728 (*Heterodera glycines*) |
| AG005 | 747 | TGGTTGGATCCAAATGAAATCAATGA | 45215079 (*Wuchereria bancrofti*) |
| AG005 | 748 | TGGATCCAAATGAAATCAATGA | 61116961 (*Litomosoides sigmodontis*) |
| AG014 | 749 | GAAGAATTTAACATTGAAAAGGG | 10122191 (*Haemonchus contortus*) |
| AG014 | 750 | GAATTTAACATTGAAAAGGGCCG | 28252967 (*Trichuris vulpis*) |
| AG016 | 751 | GGTTACATGTACACCGATTTGGC | 54552787 (*Xiphinema* index) |

TABLE 5-TC

| Target ID | SEQ ID NO | Sequence * | Example Gi-number and species |
|---|---|---|---|
| TC014 | 853 | ATCATGGAATATTACGAGAAGAA | 6562543 (*Heterodera schachtii*); 15769883 (*Heterodera glycines*) |
| TC015 | 854 | AACGGTCCCGAAATTATGAGTAAATT | 108966476 (*Bursaphelenchus xylophilus*) |

TABLE 5-MP

| Target ID | SEQ ID NO | Sequence * | Example Gi-number and species |
|---|---|---|---|
| MP001 | 1011 | GATCTTTTGATATTGTTCACATTAA | 13099294 (*Strongyloides ratti*) |
| MP001 | 1012 | ACATCCAGGATCTTTTGATATTGTTCAC | 15275671 (*Strongyloides ratti*) |
| MP001 | 1013 | TCTTTTGATATTGTTCACATTAA | 32183548 (*Meloidogyne chitwoodi*) |
| MP016 | 1014 | TATTGCTCGTGGACAAAAAAT | 9832367 (*Strongyloides stercoralis*) |
| MP016 | 1015 | TCTGCTGCTCGTGAAGAAGTACCTGG | 13418283 (*Necator americanus*) |
| MP016 | 1016 | GCTGAAGATTATTTGGATATT | 20064440 (*Meloidogyne hapla*) |

TABLE 5-MP-continued

| Target ID | SEQ ID NO | Sequence * | Example Gi-number and species |
|---|---|---|---|
| MP016 | 1017 | GGTTTACCACATAATGAGATTGCTGC | 20064440 (*Meloidogyne hapla*) |
| MP016 | 1018 | AAGAAATGATTCAAACTGGTATTTCAGCTATTGAT | 31545172 (*Strongyloides ratti*) |
| MP016 | 1019 | TATTGCTCGTGGACAAAAAATTCCAAT | 31545172 (*Strongyloides ratti*) |
| MP016 | 1020 | GTTTCTGCTGCTCGTGAAGAAGT | 31545172 (*Strongyloides ratti*) |
| MP016 | 1021 | CGTGGTTTCCCTGGTTACATGTACAC | 31545172 (*Strongyloides ratti*) |
| MP016 | 1022 | CCTGGTTACATGTACACCGATTT | 54552787 (*Xiphinema* index) |
| MP027 | 1023 | TTTAAAAATTTTAAAGAAAAA | 27540724 (*Meloidogyne hapla*) |
| MP027 | 1024 | CTATTATGTTGGTGGTGAAGTTGT | 34026304 (*Meloidogyne arenaria*) |
| MP027 | 1025 | AAAGTTTTTAAAAATTTTAAA | 34028558 (*Meloidogyne javanica*) |

TABLE 5-NL

| Target ID | SEQ ID No | Sequence * | Example Gi-number and species |
|---|---|---|---|
| NL001 | 1438 | AGTACAAGCTGTGCAAAGTGAAGA | 18087933 (*Globodera rostochiensis*), 54547517 (*Globodera pallida*) |
| NL001 | 1439 | ATGGATGTTGGACAAATTGGGTGG | 7143612 (*Globodera rostochiensis*) |
| NL001 | 1440 | TGGATGTTGGACAAATTGGGTGG | 7235910 (*Meloidogyne incognita*) |
| NL001 | 1441 | AGTACAAGCTGTGCAAAGTGAAGA | 111164813 (*Globodera rostochiensis*) |
| NL003 | 1442 | AGTCCATCCATCACGCCCGTGT | 6081031 (*Pristionchus pacificus*) |
| NL003 | 1443 | CTCCGTAACAAGCGTGAGGTGTGG | 5815927 (*Pristionchus pacificus*) |
| NL003 | 1444 | GACTCGCAGAAGCACATTGACTTCTC | 5815618 (*Pristionchus pacificus*) |
| NL003 | 1445 | GCAGAAGCACATTGACTTCTC | 6081031 (*Pristionchus pacificus*) |
| NL003 | 1446 | GCCAAGTCCATCCATCACGCCC | 6081133 (*Pristionchus pacificus*) |
| NL003 | 1447 | GCCAAGTCCATCCATCACGCCCGTGT | 1783663 (*Pristionchus pacificus*) |
| NL003 | 1448 | TCGCAGAAGCACATTGACTTCTC | 10804008 (*Ascaris suum*) |
| NL003 | 1449 | TCGCAGAAGCACATTGACTTCTCGCTGAA | 18688500 (*Ascaris suum*) |
| NL003 | 1450 | GCCAAGTCCATCCATCACGCCCGTGT | 91102596 (*Pristionchus pacificus*) |
| NL003 | 1451 | GACTCGCAGAAGCACATTGACTTCTC | 91102596 (*Pristionchus pacificus*) |
| NL003 | 1452 | CTCCGTAACAAGCGTGAGGTGTGG | 91102596 (*Pristionchus pacificus*) |
| NL004 | 1453 | AAGAACAAGGATATTCGTAAATT | 3758529 (*Onchocerca volvulus*), 6200728 (*Litomosoides sigmodontis*) |
| NL004 | 1454 | AAGAACAAGGATATTCGTAAATTCTTGGA | 21056283 (*Ascaris suum*), 2978237 (*Toxocara canis*) |
| NL004 | 1455 | CCGTGTACGCCCATTTCCCCATCAAC | 1783477 (*Pristionchus pacificus*) |
| NL004 | 1456 | TACGCCCATTTCCCCATCAAC | 2181209 (*Haemonchus contortus*) |
| NL007 | 1457 | CAACATGAATGCATTCCTCAAGC | 39747064 (*Meloidogyne paranaensis*) |
| NL007 | 1458 | GAAGTACAACATGAATGCATTCC | 6721002 (*Onchocerca volvulus*) |
| NL007 | 1459 | GCTGTATTTGTGTTGGCGACA | 27541378 (*Meloidogyne hapla*) |
| NL008 | 1460 | AGAAAAGGTTGTGGGTTGGTA | 108958003 (*Bursaphelenchus mucronatus*) |
| NL011 | 1461 | GGACTTCGTGATGGATATTACATTCAGGGACAATG | 33138488 (*Meloidogyne incognita*) |
| NL011 | 1462 | CAACTACAACTTCGAGAAGCC | 108984057 (*Bursaphelenchus xylophilus*) |

TABLE 5-NL-continued

| Target ID | SEQ ID No | Sequence * | Example Gi-number and species |
|---|---|---|---|
| NL014 | 1463 | GAAGAATTCAACATTGAAAAGGG | 11927908 (*Haemonchus contortus*) |
| NL014 | 1464 | GAGCAAGAAGCCAATGAGAAAGC | 108985855 (*Bursaphelenchus mucronatus*) |
| NL014 | 1465 | TTTCATTGAGCAAGAAGCCAATGAGAAAGCCGAAGA | 108979738 (*Bursaphelenchus xylophilus*) |
| NL015 | 1466 | ATGAGCAAATTGGCCGGCGAGTCGGAG | 18090737 (*Globodera rostochiensis*) |
| NL015 | 1467 | CACACCAAGAACATGAAGTTGGCTGA | 68276872 (*Caenorhabditis remanei*) |
| NL015 | 1468 | CAGGAAATCTGTTCGAAGTGT | 45564676 (*Meloidogyne incognita*) |
| NL015 | 1469 | CTGGCGCAGATCAAAGAGATGGT | 18090737 (*Globodera rostochiensis*) |
| NL015 | 1470 | TGGCGCAGATCAAAGAGATGGT | 27428872 (*Heterodera glycines*) |
| NL016 | 1471 | TATCCCGAGGAAATGATCCAGAC | 18081287 (*Globodera rostochiensis*) |
| NL016 | 1472 | CGTATCTATCCCGAGGAAATGATCCAGACTGGAATTTC | 108957716 (*Bursaphelenchus mucronatus*)<br>108962248 (*Bursaphelenchus xylophilus*) |
| NL023 | 1473 | TGGATGGGAGTCATGCATGGA | 13959786 (*Nippostrongylus brasiliensis*) |

TABLE 5-CS

| Target ID | SEQ ID NO | Sequence * | Example Gi-number and species |
|---|---|---|---|
| CS001 | 1988 | ATACAAGCTGTGCAAGGTGCG | 10803803 (*Trichuris muris*) |
| CS003 | 1989 | AAGCACATTGACTTCTCGCTGAA | 18850138 (*Ascaris suum*) |
| CS003 | 1990 | CGCAACAAGCGTGAGGTGTGG | 40305701 (*Heterodera glycines*) |
| CS003 | 1991 | CGTCTCCAGACTCAGGTGTTCAAG | 91102965 (*Nippostrongylus brasiliensis*) |
| CS011 | 1992 | TTTAATGTATGGGATACTGCTGG | 9832495 (*Strongyloides stercoralis*) |
| CS011 | 1993 | CACTTGACTGGAGAGTTCGAGAAAA | 18082874 (*Globodera rostochiensis*) |
| CS011 | 1994 | CTCGTGTCACCTACAAAAATGTACC | 71182695 (*Caenorhabditis remanei*) |
| CS011 | 1995 | CACTTGACTGGAGAGTTCGAGAA | 108987391 (*Bursaphelenchus xylophilus*) |
| CS013 | 1996 | TAGGTGAATTTGTTGATGATTA | 40305096 (*Heterodera glycines*) |
| CS014 | 1997 | AAGAAAGAGAAACAAGTGGAACT | 51871231 (*Xiphinema* index) |
| CS016 | 1998 | GTGTACATGTAACCTGGGAAACCACG | 10819046 (*Haemonchus contortus*) |
| CS016 | 1999 | GTGTACATGTAACCTGGGAAACC | 13418283 (*Necator americanus*) |
| CS016 | 2000 | GCCAAATCGGTGTACATGTAACC | 54552787 (*Xiphinema* index) |
| CS016 | 2001 | AAGTTCTTCTCGAACTTGGTGAGGAACTC | 111163626 (*Globodera rostochiensis*) |

TABLE 5-PX

| Target ID | SEQ ID NO | Sequence * | Example Gi-number and species |
|---|---|---|---|
| PX001 | 2291 | CTCGACATCGCCACCTGCAAG | 11069004 (*Haemonchus contortus*); 27770634 (*Teladorsagia circumcincta*) |
| PX001 | 2292 | GACGGCAAGGTCCGCACCGAC | 32320500 (*Heterodera glycines*) |
| PX001 | 2293 | CCCGGCTGGATTCATGGATGT | 51334233 (*Radopholus similis*) |
| PX001 | 2294 | ATCAAGGTGGACGGCAAGGTCCGCAC | 108959807 (*Bursaphelenchus xylophilus*) |
| PX001 | 2295 | ACAACGTGTTCATCATCGGCAA | 111166840 (*Globodera rostochiensis*) |
| PX016 | 2296 | CGTGGTTTCCCAGGTTACATGTACACGGATTGGC | 10819046 (*Haemonchus contortus*) |

TABLE 5-PX-continued

| Target ID | SEQ ID NO | Sequence * | Example Gi-number and species |
| --- | --- | --- | --- |
| PX016 | 2297 | GGTTTCCCAGGTTACATGTACAC | 13418283 (*Necator americanus*) |
| PX016 | 2298 | GAGTTCCTCACCAAGTTCGAGAAGAACTT | 111163626 (*Globodera rostochiensis*) |

TABLE 5-AD

| Target ID | SEQ ID NO | Sequence * | Example Gi-number and species |
| --- | --- | --- | --- |
| AD015 | 2439 | ATAAATGGTCCTGAAATTATGA | 9832193 (*Strongyloides stercoralis*) |
| AD016 | 2440 | GTCAACATGGAGACGGCGCGCTT | 30220804 (*Heterodera glycines*) |

TABLE 6-LD

| Target ID | SEQ ID No | Sequences* | Example Gi-number and species |
| --- | --- | --- | --- |
| LD001 | 136 | TAGCGGATGGTGCGGCCGTCGTG | 54625255 (*Phlebiopsis gigantea*) |
| LD003 | 137 | TTCCAAGAAATCTTCAATCTTCAAA | 50294437 (*Candida glabrata* CBS 138) |
| LD007 | 138 | GACTGCGGTTTTGAACACCCTTCAGAAGTTCA | 110463173 (*Rhizopus oryzae*) |
| LD007 | 139 | TGTCAAGCCAAATCTGGTATGGG | 110463173 (*Rhizopus oryzae*) |
| LD011 | 140 | GGCTTCTCAAAGTTGTAGTTA | 48898288 (*Aspergillus flavus*) |
| LD011 | 141 | CCATCACGGAGACCACCAAACTT | 60673229 (*Alternaria brassicicola*) |
| LD011 | 142 | AAAGGCTTCTCAAAGTTGTAGTTA | 58157923 (*Phytophthora infestans*) |
| LD011 | 143 | TGTGCTATTATCATGTTTGATGT | 110458937 (*Rhizopus oryzae*) |
| LD011 | 144 | ACTGCCGGTCAGGAGAAGTTTGG | 90638500 (*Thermomyces lanuginosus*) |
| LD011 | 145 | AATACAACTTTGAGAAGCCTTTCCT | 90549582 (*Lentinula edodes*), 90381505 (*Amorphotheca resinae*) |
| LD011 | 146 | CAGGAGAAGTTTGGTGGTCTCCG | 90544763 (*Gloeophyllum trabeum*) |
| LD011 | 147 | ACCACCAAACTTCTCCTGACC | 90368069 (*Aureobasidium pullulans*) |
| LD011 | 148 | GGTCAGGAGAAGTTGGTGGTCTCCG | 90355148 (*Coprinopsis cenerea*) |
| LD016 | 149 | GCAGCAATTTCATTGTGAGGCAGACCAG | 50285562 (*Candida glabrata* CBS 138) |
| LD016 | 150 | ATGGAGTTCATCACGTCAATAGC | 68419480 (*Phytophthora parasitica*) |
| LD016 | 151 | GGTCTGCCTCACAATGAAATTGCTGCCCAGAT | 85109950 (*Neurospora crassa*) |
| LD016 | 152 | CTATTGTTTTCGCTGCTATGGGTGTTAACATGGA | 50423336 (*Debaryomyces hansenii*), 90540142 (*Gloeophyllum trabeum*) |
| LD016 | 153 | ATGAACTCCATTGCTCGTGGTCAGAAGAT | 84573655 (*Aspergillus oryzae*) |
| LD016 | 154 | ATAGGAATCTGGGTGATGGATCCGTT | 90562068 (*Leucosporidium scottii*), 90359845 (*Aureobasidium pullulans*) |
| LD016 | 155 | TCCTGTTTCTGAAGATATGTTGGG | 90388021 (*Cunninghamella elegans*) |
| LD016 | 156 | TTTGAAGATTGAAGATTCTTGGAACG | 50294437 (*Candida glabrata* CBS 138), 110468393 (*Rhizopus oryzae*), 90388664 (*Cunninghamella elegans*), 90376235 (*Amorphotheca resinae*) |
| LD027 | 157 | TCACAGGCAGCGAAGATGGTACC | 90546087 (*Gloeophyllum trabeum*) |
| LD027 | 158 | TTCTTTGAAGTTTTTGAATAT | 50292600 (*Candida glabrata* CBS 138) |

TABLE 6-PC

| Target ID | SEQ ID NO | Sequence * | Example Gi-number and species |
|---|---|---|---|
| PC001 | 447 | CCCTGCTGGTTTCATGGATGTCAT | 110469463 (*Rhizopus oryzae*) |
| PC003 | 448 | ATTGAAGATTTCTTGGAAAGAAG | 50294437 (*Candida glabrata* CBS 138) |
| PC003 | 449 | TTGAAGATTTCTTGGAAAGAAG | 50310014 (*Kluyveromyces lactis* NRRL Y-1140) |
| PC003 | 450 | CTTCTTTCCAAGAAATCTTCAA | 622611 (*Saccharomyces cerevisiae*) |
| PC003 | 451 | GACTCGCAGAAGCACATCGACTT | 109744873 (*Allomyces macrogynus*); 59284959 (*Blastocladiella emersonii*); 90623359 (*Corynascus heterothallicus*); 29427071 (*Verticillium dahliae*) |
| PC003 | 452 | GACTCGCAGAAGCACATCGACTTC | 59298648 (*Blastocladiella emersonii*); 90565029 (*Leucosporidium scottii*) |
| PC003 | 453 | TCGCAGAAGCACATCGACTTC | 47032157 (*Mycosphaerella graminicola*) |
| PC003 | 454 | CAGAAGCACATCGACTTCTCCCT | 34332427 (*Ustilago maydis*) |
| PC005 | 455 | CTTATGGAGTACATCCACAAG | 98997063 (*Spizellomyces punctatus*) |
| PC005 | 456 | AAGAAGAAGGCAGAGAAGGCCA | 84572408 (*Aspergillus oryzae*) |
| PC010 | 457 | GTGTTCAATAATTCTCCTGATGA | 50288722 (*Candida glabrata* CBS 138) |
| PC010 | 458 | ATTTTCCATGGAGAGACCATTGC | 70990481 (*Aspergillus fumigatus*) |
| PC010 | 459 | GGGCAGAATCCCCAAGCTGCC | 90631635 (*Thermomyces lanuginosus*) |
| PC014 | 460 | AATACAAGGACGCCACCGGCA | 30394561 (*Magnaporthe grisea*) |
| PC016 | 461 | ATGCCCAACGACGACATCACCCA | 59281308 (*Blastocladiella emersonii*) |
| PC016 | 462 | TGGGTGATGTCGTCGTTGGGCAT | 38353161 (*Hypocrea jecorina*) |
| PC016 | 463 | GGTTTCCCCGGTTACATGTACAC | 34447668 (*Cryphonectria parasitica*) |
| PC016 | 464 | ACTATGCCCAACGACGACATCAC | 34447668 (*Cryphonectria parasitica*) |
| PC016 | 465 | CCGGGCACTTCTTCTCGAGCGGC | 38353161 (*Hypocrea jecorina*) |
| PC016 | 466 | CCGACCATCGAGCGCATCATCAC | 59281308 (*Blastocladiella emersonii*) |
| PC016 | 467 | TTCTTGAACTTGGCCAACGATCC | 50285562 (*Candida glabrata* CBS 138) |
| PC016 | 468 | TGTTCTTGAACTTGGCCAACGA | 66909391 (*Phaeosphaeria nodorum*) |
| PC016 | 469 | GCTATGGGTGTCAACATGGAAACTGC | 110463410 (*Rhizopus oryzae*) |
| PC016 | 470 | TGCTATGGGTGTCAACATGGA | 71006197 (*Ustilago maydis*) |
| PC016 | 471 | CTATTGTGTTTGCTGCTATGGGTGT | 68488910 (*Candida albicans*) |
| PC016 | 472 | TACGAGCGCGCCGGTCGTGTGGA | 90347883 (*Coprinopsis cinerea*) |

TABLE 6-EV

| Target ID | SEQ ID NO | Sequence * | Example Gi-number and species |
|---|---|---|---|
| EV010 | 565 | TTCAATAATTCACCAGATGAAAC | 50405834 (*Debaryomyces hansenii*) |
| EV015 | 566 | CGATCGCCTTGAACAGCGACG | 22502898 (*Gibberella zeae*) |
| EV015 | 567 | GTTACCATGGAGAACTTCCGTTA | 67900533 (*Aspergillus nidulans* FGSC A4) |
| EV015 | 568 | GTTACCATGGAGAACTTCCGTTACGCC | 70820241 (*Aspergillus niger*) |
| EV015 | 569 | ACCATGGAGAACTTCCGTTACGCC | 84573628 (*Aspergillus oryzae*) |
| EV015 | 570 | ATGGAGAACTTCCGTTACGCC | 71002727 (*Aspergillus fumigatus*) |
| EV016 | 571 | TCTGAAGATATGTTGGGTCGTGT | 90396765 (*Cunninghamella elegans*) |
| EV016 | 572 | CAAAAGATTCCAATTTTCTCTGCA | 50306984 (*Kluyveromyces lactis* NRRL Y-1140) |

TABLE 6-EV-continued

| Target ID | SEQ ID NO | Sequence * | Example Gi-number and species |
|---|---|---|---|
| EV016 | 573 | CCCCACAATGAAATCGCTGCTCAAAT | 68001221 (*Schizosaccharomyces pombe* 972h-) |
| EV016 | 574 | ATCGTTTTCGCCGCTATGGGTGT | 58271359 (*Cryptococcus neoformans* var.) |
| EV016 | 575 | TTCAAGCAAGATTTTGAAGAGAATGG | 50285562 (*Candida glabrata* CBS 138) |

TABLE 6-AG

| Target ID | SEQ ID NO | Sequence * | Example Gi-number and species |
|---|---|---|---|
| AG001 | 752 | CGTAACAGGTTGAAGTACGCCCT | 16931515 (*Coccidioides posadasii*) |
| AG001 | 753 | AAGGTCGACGGCAAAGTCAGGACTGAT | 33515688 (*Cryptococcus neoformans* var.) |
| AG001 | 754 | CCATTCTTGGTCACCCACGATG | 38132640 (*Hypocrea jecorina*) |
| AG001 | 755 | ATCAAGGTAAACGACACCATC | 56939474 (*Puccinia graminis* f. sp.) |
| AG005 | 756 | TGTACATGAAGGCCAAGGGTAACGTGTTCAAGAACAAG | 98997063 (*Spizellomyces punctatus*) |
| AG005 | 757 | CCAAGGGTAACGTGTTCAAGAACAAG | 109744763 (*Allomyces macrogynus*); 59297176 (*Blastocladiella emersonii*) |
| AG005 | 758 | AAGGGTAACGTGTTCAAGAACAAG | 109741162 (*Allomyces macrogynus*) |
| AG005 | 759 | CAAGAAGAAGGCTGAGAAGGC | 67903433 (*Aspergillus nidulans* FGSC A4) |
| AG005 | 760 | CAAGAAGAAGGCTGAGAAGGC | 4191107 (*Emericella nidulans*) |
| AG005 | 761 | AAGAAGAAGGCTGAGAAGGCC | 66909252 (*Phaeosphaeria nodorum*) |
| AG005 | 762 | CAAAACATCCGTAAATTGATCAAGGATGGTTT | 21649803 (*Conidiobolus coronatus*) |
| AG016 | 763 | TTCGCCGCCATGGGTGTCAAC | 50554108 (*Yarrowia lipolytica*) |
| AG016 | 764 | ATGGGTGTCAACATGGAAACCGC | 90639144 (*Trametes versicolor*) |
| AG016 | 765 | TGGAAACCGCCCGTTTCTTCA | 85109950 (*Neurospora crassa*) |
| AG016 | 766 | GGTTACATGTACACCGATTTG | 32169825 (*Mucor circinelloides*) |
| AG016 | 767 | GTCAAGATGGGAATCTGGGTGATGGA | 38353161 (*Hypocrea jecorina*) |

TABLE 6-TC

| Target ID | SEQ ID NO | Sequence * | Example Gi-number and species |
|---|---|---|---|
| TC001 | 855 | AACAGGCTGAAGTATGCCTTGACC | 90545567 (*Gloeophyllum trabeum*) |
| TC015 | 856 | TTCATCGTCCGTGGTGGCATG | 46122304 (*Gibberella zeae* PH-1) |
| TC015 | 857 | AGTTTTACCGGTACCTGGAGG | 50310636 (*Kluyveromyces lactis* NRRL Y-1140) |
| TC015 | 858 | CCTCCAGGTACCGGTAAAACT | 85114224 (*Neurospora crassa*) |
| TC015 | 859 | CCTCCAGGTACCGGTAAAACTTT | 50290674 (*Candida glabrata* CBS 138) |
| TC015 | 860 | ATTAAGTTTTACCGGTACCTGGAGG | 3356460 (*Schizosaccharomyces pombe*) |
| TC015 | 861 | GGTGCTTTCTTCTTCTTAATCAA | 21649889 (*Conidiobolus coronatus*) |
| TC015 | 862 | ATCAACGGTCCCGAAATTATG | 82610024 (*Phanerochaete chrysosporium*) |

TABLE 6-MP

| Target ID | SEQ ID NO | Sequence * | Example Gi-number and species |
|---|---|---|---|
| MP002 | 1026 | AATTTTTAGAAAAAAAAATTG | 68026454 (*Schizosaccharomyces pombe* 972h-) |
| MP010 | 1027 | GTCACCACATTAGCTAGGAAT | 48564349 (*Coccidioides posadasii*) |

TABLE 6-MP-continued

| Target ID | SEQ ID NO | Sequence * | Example Gi-number and species |
|---|---|---|---|
| MP016 | 1028 | AAGAAATGATTCAAACTGGTAT | 90396765 (*Cunninghamella elegans*) |
| MP016 | 1029 | AAGAAATGATTCAAACTGGTATTTC | 110463410 (*Rhizopus oryzae*) |
| MP016 | 1030 | CATGAACTCTATTGCTCGTGG | 50285562 (*Candida glabrata* CBS 138) |
| MP016 | 1031 | GCTGCTATGGGTGTTAATATGGA | 90348219 (*Coprinopsis cinerea*) |
| MP016 | 1032 | TGCTATGGGTGTTAATATGGAAAC | 90396964 (*Cunninghamella elegans*) |
| MP016 | 1033 | CCTACTATTGAGCGTATCATTAC | 90524974 (*Geomyces pannorum*) |
| MP016 | 1034 | GAAGTTTCTGCTGCTCGTGAAGAAGTACCTGG | 90396313 (*Cunninghamella elegans*) |
| MP016 | 1035 | GTTTCTGCTGCTCGTGAAGAAGT | 32169825 (*Mucor circinelloides*) |
| MP016 | 1036 | GTGTACATGTAACCAGGGAAACCACG | 45392344 (*Magnaporthe grisea*) |
| MP016 | 1037 | CCTGGTTACATGTACACCGATTT | 32169825 (*Mucor circinelloides*) |
| MP016 | 1038 | GGTTACATGTACACCGATTTA | 47067814 (*Eremothecium gossypii*) |
| MP016 | 1039 | CCTATTTTAACTATGCCTAACGA | 90396313 (*Cunninghamella elegans*) |
| MP027 | 1040 | ACTCTCCATCACCACATACTA | 60673889 (*Alternaria brassicicola*) |

TABLE 6-NL

| Target ID | SEQ ID No | Sequence * | Example Gi-number and species |
|---|---|---|---|
| NL001 | 1474 | CCAAGGGCAAGGGTGTGAAGCTCA | 30418788 (*Magnaporthe grisea*) |
| NL001 | 1475 | TCTCTGCCCAAGGGCAAGGGTGT | 22500578 (*Gibberella zeae*), 46128672 (*Gibberella zeae* PH-1), 70662858 (*Gibberella moniliformis*), 71000466 (*Aspergillus fumigatus*) |
| NL001 | 1476 | TCTGCCCAAGGGCAAGGGTGT | 14664568 (*Fusarium sporotrichioides*) |
| NL001 | 1477 | TCTCTGCCCAAGGGCAAGGGT | 50550586 (*Yarrowia lipolytica*) |
| NL001 | 1478 | TCTCTGCCCAAGGGCAAGGGTGT | 71000466 (*Aspergillus fumigatus*) 92459259 (*Gibberella zeae*) |
| NL001 | 1479 | CTGCCCAAGGGCAAGGGTGTGAAG | 90545567 (*Gloeophyllum trabeum*) |
| NL003 | 1480 | ATGAAGCTCGATTACGTCTTGG | 24446027 (*Paracoccidioides brasiliensis*) |
| NL003 | 1481 | CGTAAGGCCGCTCGTGAGCTG | 10229753 (*Phytophthora infestans*) |
| NL003 | 1482 | CGTAAGGCCGCTCGTGAGCTGTTGAC | 58082846 (*Phytophthora infestans*) |
| NL003 | 1483 | GACTCGCAGAAGCACATTGACTT | 21393181 (*Pratylenchus penetrans*), 34330401 (*Ustilago maydis*) |
| NL003 | 1484 | TGAAGCTCGATTACGTCTTGG | 46346864 (*Paracoccidioides brasiliensis*) |
| NL003 | 1485 | TGGCCAAGTCCATCCATCACGCCCGTGT | 58113938 (*Phytophthora infestans*) |
| NL004 | 1486 | CGTAACTTCCTGGGCGAGAAG | 58127885 (*Phytophthora infestans*) |
| NL003 | 1487 | ATGAAGCTCGATTACGTCTTGG | 90366381 (*Aureobasidium pullulans*) |
| NL003 | 1488 | TCGGTTTGGCCAAGTCCATCCA | 90353540 (*Coprinopsis cinerea*) |
| NL003 | 1489 | GACTCGCAGAAGCACATTGACTT | 71012467 (*Ustilago maydis*) |
| NL003 | 1490 | GACTCGCAGAAGCACATTGACTTCTC | 90616286 (*Ophiostoma piliferum*) |
| NL004 | 1491 | TACGCCCATTTCCCCATCAAC | 15771856 (*Gibberella zeae*), 29426217 (*Verticillium dahliae*), 30399988 (*Magnaporthe grisea*), 34330394 (*Ustilago maydis*), 39945691 (*Magnaporthe grisea* 70-15), 46108543 (*Gibberella zeae* PH-1), 70660620 (*Gibberella moniliformis*) |

TABLE 6-NL-continued

| Target ID | SEQ ID No | Sequence * | Example Gi-number and species |
|---|---|---|---|
| NL004 | 1492 | CGTGTACGCCCATTTCCCCATCAAC | 90615722 (*Ophiostoma piliferum*) |
| NL004 | 1493 | TACGCCCATTTCCCCATCAAC | 90367524 (*Aureobasidium pullulans*)<br>90372622 (*Cryptococcus laurentii*)<br>109654277 (*Fusarium oxysporum f. sp.*)<br>90535059 (*Geomyces pannorum*)<br>46108543 (*Gibberella zeae PH-1*)<br>90566138 (*Leucosporidium scottii*)<br>39945691 (*Magnaporthe grisea 70-15*)<br>110115733 (*Saitoella complicata*)<br>110081735 (*Tuber borchii*)<br>71021510 (*Ustilago maydis*)<br>50554252 (*Yarrowia lipolytica*) |
| NL004 | 1494 | TACGCCCATTTCCCCATCAACTG | 90640952 (*Trametes versicolor*) |
| NL004 | 1495 | CGTGTACGCCCATTTCCCCATCAAC | 90615722 (*Ophiostoma piliferum*) |
| NL005 | 1496 | AAAAGGTCAAGGAGGCCAAGA | 14662414 (*Fusarium sporotrichioides*) |
| NL005 | 1497 | TTCAAGAACAAGCGTGTATTGATGGA | 90395504 (*Cunninghamella elegans*) |
| NL005 | 1498 | TTCAAGAACAAGCGTGTATTGATGGAGT | 90542553 (*Gloeophyllum trabeum*) |
| NL006 | 1499 | CCTGGAGGAGGAGACGACCAT | 70998503 (*Aspergillus fumigatus*) |
| NL006 | 1500 | TCCCATCTCGTATGACAATTGG | 68471154 (*Candida albicans*) |
| NL006 | 1501 | ATGGTCGTCTCCTCCTCCAGG | 70998503 (*Aspergillus fumigatus*) |
| NL006 | 1502 | TCCCATCTCGTATGACAATTGG | 68471154 (*Candida albicans*)<br>50425488 (*Debaryomyces hansenii*) |
| NL007 | 1503 | CAAGTCATGATGTTCAGTGCAAC | 70984614 (*Aspergillus fumigatus*) |
| NL007 | 1504 | TGACGCTTCACGGCCTGCAGCAG | 10229203 (*Phytophthora infestans*) |
| NL007 | 1505 | CAAGTCATGATGTTCAGTGCAAC | 70984614 (*Aspergillus fumigatus*) |
| NL010_2 | 1506 | CAATTCTTGCAAGTGTTCAACAA | 68478799 (*Candida albicans*) |
| NL010_2 | 1507 | TTCAACAACAGTCCTGATGAAAC | 21649260 (*Conidiobolus coronatus*) |
| NL010_2 | 1508 | TTCTTGCAAGTGTTCAACAAC | 47031965 (*Mycosphaerella graminicola*) |
| NL011 | 1509 | AAGAACGTTCCCAACTGGCAC | 68132303 (*Trichophyton rubrum*) |
| NL011 | 1510 | ACAAGAACGTTCCCAACTGGCA | 68132303 (*Trichophyton rubrum*) |
| NL011 | 1511 | ACCTACAAGAACGTTCCCAACT | 68132303 (*Trichophyton rubrum*) |
| NL011 | 1512 | ACCTACAAGAACGTTCCCAACTGGCAC | 70674996 (*Gibberella moniliformis*) |
| NL011 | 1513 | CAACTACAACTTCGAGAAGCC | 22500425 (*Gibberella zeae*), 34331122 (*Ustilago maydis*), 46108433 (*Gibberella zeae PH-1*), 47029512 (*Mycosphaerella graminicola*), 56236507 (*Setosphaeria turcica*), 62926335 (*Fusarium oxysporum f. sp.*), 70674996 (*Gibberella moniliformis*), 70992714 (*Aspergillus fumigatus*) |
| NL011 | 1514 | CAAGAACGTTCCCAACTGGCAC | 68132303 (*Trichophyton rubrum*) |
| NL011 | 1515 | CACCTACAAGAACGTTCCCAAC | 68132303 (*Trichophyton rubrum*) |
| NL011 | 1516 | CCTACAAGAACGTTCCCAACTG | 68132303 (*Trichophyton rubrum*) |
| NL011 | 1517 | CTACAAGAACGTTCCCAACTGG | 68132303 (*Trichophyton rubrum*) |
| NL011 | 1518 | GCAACTACAACTTCGAGAAGCC | 22505588 (*Gibberella zeae*) |
| NL011 | 1519 | TACAAGAACGTTCCCAACTGGC | 68132303 (*Trichophyton rubrum*) |
| NL011 | 1520 | TCACCTACAAGAACGTTCCCA | 68132303 (*Trichophyton rubrum*) |
| NL011 | 1521 | TCACCTACAAGAACGTTCCCAA | 68132303 (*Trichophyton rubrum*) |
| NL011 | 1522 | TCACCTACAAGAACGTTCCCAACT | 30405871 (*Magnaporthe grisea*) |

TABLE 6-NL-continued

| Target ID | SEQ ID No | Sequence * | Example Gi-number and species |
|---|---|---|---|
| NL011 | 1523 | TCACCTACAAGAACGTTCCCAACTGGCAC | 13903501 (*Blumeria graminis f. sp.*), 3140444 (*Emericella nidulans*), 34331122 (*Ustilago maydis*), 49096317 (*Aspergillus nidulans* FGSC A4) |
| NL011 | 1524 | TGGGACACAGCTGGCCAGGAAA | 14180743 (*Magnaporthe grisea*), 39950145 (*Magnaporthe grisea* 70-15) |
| NL011 | 1525 | TTCGAGAAGCCGTTCCTGTGG | 38056576 (*Phytophthora sojae*), 45244260 (*Phytophthora nicotianae*), 58091236 (*Phytophthora infestans*) |
| NL011 | 1526 | TTCGAGAAGCCGTTCCTGTGGTTGGC | 58090083 (*Phytophthora infestans*) |
| NL011 | 1527 | TGGGACACAGCTGGCCAGGAAA | 39950145 (*Magnaporthe grisea* 70-15) |
| NL011 | 1528 | TATTACATTCAGGGACAATGCG | 110134999 (*Taphrina deformans*) |
| NL011 | 1529 | TCACCTACAAGAACGTTCCCAACTGGCAC | 84573903 (*Aspergillus oryzae*) 90355199 (*Coprinopsis cinerea*) 90624693 (*Corynascus heterothallicus*) 90638500 (*Thermomyces lanuginosus*) |
| NL011 | 1530 | ACCTACAAGAACGTTCCCAACTGGCAC | 113544700 (*Cordyceps bassiana*) 85114463 (*Neurospora crassa*) |
| NL011 | 1531 | TACAAGAACGTTCCCAACTGGCA | 110269748 (*Hypocrea lixii*) |
| NL011 | 1532 | TACAAGAACGTTCCCAACTGGCAC | 110458937 (*Rhizopus oryzae*) |
| NL011 | 1533 | AGGAAGAAGAACCTTCAGTACT | 90557551 (*Leucosporidium scottii*) |
| NL011 | 1534 | AAGAAGAACCTTCAGTACTACGA | 113551594 (*Cordyceps bassiana*) |
| NL011 | 1535 | AAGAAGAACCTTCAGTACTACGACATC | 90036917 (*Trichophyton rubrum*) |
| NL011 | 1536 | AAGAACCTTCAGTACTACGACATC | 90624693 (*Corynascus heterothallicus*) |
| NL011 | 1537 | GGCTTCTCGAAGTTGTAGTTGC | 89975123 (*Hypocrea lixii*) |
| NL011 | 1538 | CAACTACAACTTCGAGAAGCC | 70992714 (*Aspergillus fumigatus*) 90368808 (*Aureobasidium pullulans*) 90629512 (*Corynascus heterothallicus*) 109656121 (*Fusarium oxysporum f. sp.*) 90532849 (*Geomyces pannorum*) 110272576 (*Hypocrea lixii*) 47029512 (*Mycosphaerella graminicola*) 85114463 (*Neurospora crassa*) 90617165 (*Ophiostoma piliferum*) 90036917 (*Trichophyton rubrum*) |
| NL011 | 1539 | GGCTTCTCGAAGTTGTAGTTG | 92233975 (*Gibberella zeae*) |
| NL013 | 1540 | CCCGAGATGGTGGTGGGCTGGTACCA | 49069733 (*Ustilago maydis*) |
| NL013 | 1541 | GGTACCACTCGCACCCGGGCTT | 58134950 (*Phytophthora infestans*) |
| NL013 | 1542 | GTGGGCTGGTACCACTCGCACCCGGGC TTCGGCTGCTGGCTGTCGGG | 38062327 (*Phytophthora sojae*) |
| NL013 | 1543 | TGGTACCACTCGCACCCGGGCTT | 58084933 (*Phytophthora infestans*) |
| NL013 | 1544 | CCCGAGATGGTGGTGGGCTGGTACCA | 71006043 (*Ustilago maydis*) |
| NL015 | 1545 | ATCCACACCAAGAACATGAAG | 10181857 (*Aspergillus niger*), 22505190 (*Gibberella zeae*), 30394634 (*Magnaporthe grisea*), 33507832 (*Cryptococcus neoformans* var.), 3773467 (*Emericella nidulans*), 39940093 (*Magnaporthe grisea* 70-15), 46122304 (*Gibberella zeae* PH-1), 47032030 (*Mycosphaerella graminicola*), 49106059 (*Aspergillus nidulans* FGSC A4) |
| NL015 | 1546 | CACACCAAGAACATGAAGTTGG | 21649889 (*Conidiobolus coronatus*) |
| NL015 | 1547 | GCCTTCTTCTTCCTCATCAACGG | 46122304 (*Gibberella zeae* PH-1) |
| NL015 | 1548 | TTGGAGGCTGCAGAAAGCAGCT | 90369178 (*Cryptococcus laurentii*) |
| NL015 | 1549 | GCCTTCTTCTTCCTCATCAACGG | 46122304 (*Gibberella zeae* PH-1) |

TABLE 6-NL-continued

| Target ID | SEQ ID No | Sequence * | Example Gi-number and species |
|---|---|---|---|
| NL015 | 1550 | ATCCACACCAAGAACATGAAG | 70820941 (*Aspergillus niger*) 58260307 (*Cryptococcus neoformans* var.) 85691122 (*Encephalitozoon cuniculi* GB-M1) 46122304 (*Gibberella zeae* PH-1) 39940093 (*Magnaporthe grisea* 70-15) 85082882 (*Neurospora crassa*) 50555821 (*Yarrowia lipolytica*) |
| NL015 | 1551 | CACACCAAGAACATGAAGTTGGC | 110272618 (*Hypocrea lixii*) |
| NL016 | 1552 | CATGAACTCGATTGCTCGTGG | 30418452 (*Magnaporthe grisea*), 39942327 (*Magnaporthe grisea* 70-15) |
| NL016 | 1553 | CCACCATCTACGAGCGCGCCGGACG | 39942327 (*Magnaporthe grisea* 70-15), 45392344 (*Magnaporthe grisea*) |
| NL016 | 1554 | CATGAACTCGATTGCTCGTGG | 90367610 (*Aureobasidium pullulans*) 39942327 (*Magnaporthe grisea* 70-15) |
| NL016 | 1555 | CATGTCGGTGAGGATGACGAG | 90562068 (*Leucosporidium scottii*) |
| NL016 | 1556 | CCACCATCTACGAGCGCGCCGGACG | 39942327 (*Magnaporthe grisea* 70-15) |
| NL019 | 1557 | CAGATTTGGGACACGGCCGGCCAGGAGCG | 9834078 (*Phytophthora sojae*) |
| NL019 | 1558 | GACCAGGAGTCGTTCAACAAC | 9834078 (*Phytophthora sojae*) |
| NL019 | 1559 | TGGGACACGGCCGGCCAGGAG | 38056576 (*Phytophthora sojae*), 40545332 (*Phytophthora nicotianae*), 58083674 (*Phytophthora infestans*) |
| NL019 | 1560 | TGGGACACGGCCGGCCAGGAGCG | 29426828 (*Verticillium dahliae*), 38057141 (*Phytophthora sojae*) |
| NL019 | 1561 | TGGGACACGGCCGGCCAGGAGCGGTT | 70981934 (*Aspergillus fumigatus*) |
| NL019 | 1562 | TTCCTGGAGACGTCGGCGAAGAACGC | 90643518 (*Trametes versicolor*) |
| NL019 | 1563 | CAGATTTGGGACACGGCCGGCCAGGAGCG | 90616605 (*Ophiostoma piliferum*) |
| NL019 | 1564 | TGGGACACGGCCGGCCAGGAG | 110272626 (*Hypocrea lixii*) |
| NL019 | 1565 | TGGGACACGGCCGGCCAGGAGCG | 50550714 (*Yarrowia lipolytica*) |
| NL019 | 1566 | TGGGACACGGCCGGCCAGGAGCGGTT | 70981934 (*Aspergillus fumigatus*) |
| NL019 | 1567 | TGGGACACGGCCGGCCAGGAGCGGTTCCG | 50553761 (*Yarrowia lipolytica*) |
| NL022 | 1568 | CAGGCAAAGATTTTCCTGCCCA | 58124185 (*Phytophthora infestans*) |
| NL022 | 1569 | GGCAAGTGCTTCCGTCTGTACAC | 58124872 (*Phytophthora infestans*) |
| NL023 | 1570 | GGATGACCAAAAACGTATTCT | 46137132 (*Gibberella zeae* PH-1) |
| NL023 | 1571 | AGAATACGTTTTTGGTCATCC | 46137132 (*Gibberella zeae* PH-1) |

TABLE 6-CS

| Target ID | SEQ ID NO | Sequence * | Example Gi-number and species |
|---|---|---|---|
| CS003 | 2002 | TGGTCTCCGCAACAAGCGTGA | 46356829 (*Paracoccidioides brasiliensis*) |
| CS003 | 2003 | GGTCTCCGCAACAAGCGTGAG | 71012467 (*Ustilago maydis*) |
| CS003 | 2004 | TGGTCTCCGCAACAAGCGTGAGGT | 5832048 (*Botryotinia fuckeliana*) |
| CS003 | 2005 | TGGTCTCCGCAACAAGCGTGAGGT | 40545704 (*Sclerotinia sclerotiorum*) |
| CS003 | 2006 | GGTCTCCGCAACAAGCGTGAGGT | 21907821 (*Colletotrichum trifolii*); 90623359 (*Corynascus heterothallicus*); 94331331 (*Pyronema omphalodes*); 29427071 (*Verticillium dahliae*) |

TABLE 6-CS-continued

| Target ID | SEQ ID NO | Sequence * | Example Gi-number and species |
|---|---|---|---|
| CS003 | 2007 | TGGTCTCCGCAACAAGCGTGAGGTGTGG | 27439041 (*Chaetomium globosum*); 47032270 (*Mycosphaerella graminicola*) |
| CS003 | 2008 | CGCAACAAGCGTGAGGTGTGG | 71000428 (*Aspergillus fumigatus*); 67537265 (*Aspergillus nidulans* FGSC A4); 70825441 (*Aspergillus niger*); 84573806 (*Aspergillus oryzae*); 3773212 (*Emericella nidulans*); 90632673 (*Thermomyces lanuginosus*); 34332427 (*Ustilago maydis*) |
| CS006 | 2009 | TCCCCTCTCGTATGACAATTGGT | 68011927 (*Schizosaccharomyces pombe* 972h-) |
| CS007 | 2010 | ATTTAGCTTTGACAAAGAATA | 50305206 (*Kluyveromyces lactis* NRRL Y-1140) |
| CS007 | 2011 | GAGCACCCTTCAGAAGTTCAACA | 90553133 (*Lentinula edodes*) |
| CS011 | 2012 | TGGGATACTGCTGGCCAAGAA | 90385536 (*Amorphotheca resinae*); 68475609 (*Candida albicans*); 50304104 (*Kluyveromyces lactis* NRRL Y-1140); 85105150 (*Neurospora crassa*) |
| CS011 | 2013 | AAGTTTGGTGGTCTCCGAGATGGTTACTA | 90355199 (*Coprinopsis cinerea*) |
| CS011 | 2014 | CAATGTGCCATCATCATGTTCGA | 15276938 (*Glomus intraradices*) |
| CS011 | 2015 | CATCATCATGTTCGATGTAAC | 28268268 (*Chaetomium globosum*) |
| CS011 | 2016 | CACTTGACTGGAGAGTTCGAGAA | 90368808 (*Aureobasidium pullulans*); 34331122 (*Ustilago maydis*) |
| CS011 | 2017 | TGAAGGTTCTTTTTCTGTGGAA | 6831345 (*Pneumocystis carinii*) |
| CS013 | 2018 | GGATGGTACCACTCGCATCCTGG | 109651225 (*Fusarium oxysporum* f. sp.) |
| CS015 | 2019 | AACGAGAGGAAGAAGAAGAAG | 39944615 (*Magnaporthe grisea* 70-15) |
| CS015 | 2020 | AGGGCTTCTTCTTCTTCCTCTC | 14662870 (*Fusarium sporotrichioides*) |
| CS015 | 2021 | TAGGGCTTCTTCTTCTTCCTC | 85112692 (*Neurospora crassa*) |
| CS015 | 2022 | GAGATGGTCGAGTTGCCTCTA | 71005073 (*Ustilago maydis*) |
| CS016 | 2023 | GCTGAAGACTTTTTGGACATC | 30418452 (*Magnaporthe grisea*) |
| CS016 | 2024 | CCTCACCAAGTTCGAGAAGAACTTC | 90566317 (*Leucosporidium scottii*) |
| CS016 | 2025 | GTCGTCGGTGAGGAAGCCCTG | 84573655 (*Aspergillus oryzae*) |
| CS016 | 2026 | TCCTCACCGACGACAGCCTTCATGGCC | 29427786 (*Verticillium dahliae*) |
| CS016 | 2027 | GATGTTTCCAACCAGCTGTACGCC | 90368806 (*Aureobasidium pullulans*) |
| CS016 | 2028 | GGCGTACAGCTGGTTGGAAACATC | 29427786 (*Verticillium dahliae*) |
| CS016 | 2029 | TGATGTTTCCAACCAGCTGTACGCC | 46107507 (*Gibberella zeae* PH-1) |
| CS016 | 2030 | ATGGCAGACTTCATGAGACGAGA | 29427786 (*Verticillium dahliae*) |
| CS016 | 2031 | ATGCCCAACGACGACATCACCCA | 59281308 (*Blastocladiella emersonii*) |
| CS016 | 2032 | TGGGTGATGTCGTCGTTGGGCAT | 38353161 (*Hypocrea jecorina*) |
| CS016 | 2033 | ACTATGCCCAACGACGACATCAC | 34447668 (*Cryphonectria parasitica*) |
| CS016 | 2034 | GGTTACATGTACACCGATTTG | 32169825 (*Mucor circinelloides*) |
| CS016 | 2035 | CCCAGGTTACATGTACACCGATTT | 47067814 (*Eremothecium gossypii*) |
| CS016 | 2036 | ACACCACGTTTGGCCTTGACT | 68488910 (*Candida albicans*) |
| CS016 | 2037 | GCCATGGGTGTGAACATGGAGAC | 82608508 (*Phanerochaete chrysosporium*) |
| CS016 | 2038 | GACGACCACGAGGACAACTTTGCCATCGTGTTCG | 59277641 (*Blastocladiella emersonii*) |
| CS016 | 2039 | AAGATCCCCATTTTCTCGGCTGC | 90348219 (*Coprinopsis cinerea*) |

TABLE 6-PX

| Target ID | SEQ ID NO | Sequence * | Example Gi-number and species |
|---|---|---|---|
| PX001 | 2299 | CTCATCAAGGTGGACGGCAAGGT | 85080580 (Neurospora crassa) |
| PX001 | 2300 | TCGGTGCGGACCTTGCCGTCCACCTTGA | 70768092 (Gibberella moniliformis) |
| PX001 | 2301 | GACGGCAAGGTCCGCACCGAC | 109745014 (Allomyces macrogynus); 60673542 (Alternaria brassicicola); 90368699 (Aureobasidium pullulans); 59299145 (Blastocladiella emersonii); 27438899 (Chaetomium globosum); 90623992 (Corynascus heterothallicus); 89975695 (Hypocrea lixii); 99039195 (Leptosphaeria maculans); 39970560 (Magnaporthe grisea); 47731115 (Metarhizium anisopliae); 90036859 (Trichophyton rubrum); 29427127 (Verticillium dahliae) |
| PX001 | 2302 | GACGGCAAGGTCCGCACCGACCC | 70823112 (Aspergillus niger); 90633197 (Thermomyces lanuginosus) |
| PX001 | 2303 | AAGGTCCGCACCGACCCCACCTACCC | 71015993 (Ustilago maydis) |
| PX001 | 2304 | CGCTTCACCATCCACCGCATCAC | 90639458 (Trametes versicolor) |
| PX001 | 2305 | CGAGGAGGCCAAGTACAAGCTG | 78177454 (Chaetomium cupreum); 27438899 (Chaetomium globosum) |
| PX001 | 2306 | GAGGCCAAGTACAAGCTGTGCAAGGT | 109745014 (Allomyces macrogynus) |
| PX001 | 2307 | GCCAAGTACAAGCTGTGCAAG | 45923813 (Coccidioides posadasii) |
| PX001 | 2308 | CCCGACCCGCTCATCAAGGTCAACGAC | 78177454 (Chaetomium cupreum) |
| PX001 | 2309 | CGACATCGTCCACATCAAGGAC | 82603501 (Phanerochaete chrysosporium) |
| PX001 | 2310 | CCGCACAAGCTGCGCGAGTGCCTGCCGCTC | 109745014 (Allomyces macrogynus) |
| PX010 | 2311 | TTCGACCAGGAGGCGGCGGCGGT | 90542152 (Gloeophyllum trabeum) |
| PX010 | 2312 | CACCACCGCCGCCGCCTCCTG | 84578035 (Aspergillus oryzae) |
| PX010 | 2313 | TGCAGGTCTTCAACAACTCGCCCGACGA | 39978050 (Magnaporthe grisea) |
| PX010 | 2314 | TTCAACAACTCGCCCGACGAGAC | 90618424 (Corynascus heterothallicus) |
| PX015 | 2315 | CATGCGCGCCGTCGAGTTCAAGGTGGT | 59282860 (Blastocladiella emersonii) |
| PX015 | 2316 | GCATTCTTCTTCCTCATCAACGG | 68323226 (Coprinopsis cinerea) |
| PX015 | 2317 | ATCAACGGCCCCGAGATCATGTC | 85082882 (Neurospora crassa) |
| PX015 | 2318 | TGCGCAAGGCGTTCGAGGAGGC | 71002727 (Aspergillus fumigatus) |
| PX016 | 2319 | CCTCACCAAGTTCGAGAAGAACTTC | 90566317 (Leucosporidium scottii) |
| PX016 | 2320 | GAGGAGATGATCCAGACTGGTAT | 90639144 (Trametes versicolor) |
| PX016 | 2321 | GAGGAGATGATCCAGACTGGTATCTC | 58271359 (Cryptococcus neoformans) |
| PX016 | 2322 | ATGAACTCCATCGCCCGTGGTCAGAAGATCCC | 90545177 (Gloeophyllum trabeum) |
| PX016 | 2323 | GTCAGAAGATCCCCATCTTCTCCGCC | 9651842 (Emericella nidulans) |
| PX016 | 2324 | CAGAAGATCCCCATCTTCTCCGC | 70825597 (Aspergillus niger); 90611576 (Ophiostoma piliferum); 90639144 (Trametes versicolor) |
| PX016 | 2325 | CAGAAGATCCCCATCTTCTCCGCC | 67540123 (Aspergillus nidulans) |
| PX016 | 2326 | CAGAAGATCCCCATCTTCTCCGCCGCCGG | 59283275 (Blastocladiella emersonii) |
| PX016 | 2327 | AAGATCCCCATCTTCTCCGCCGCCGGTCT | 34447668 (Cryphonectria parasitica) |
| PX016 | 2328 | CCCATCTTCTCCGCCGCCGGTCTGCC | 90621827 (Corynascus heterothallicus) |
| PX016 | 2329 | GGTCTGCCCCACAACGAGATTGCTGC | 90367610 (Aureobasidium pullulans); 66909391 (Phaeosphaeria nodorum) |
| PX016 | 2330 | TTCGCCGCCATGGGAGTCAACATGGAGAC | 90562163 (Leucosporidium scottii) |

TABLE 6-PX-continued

| Target ID | SEQ ID NO | Sequence * | Example Gi-number and species |
|---|---|---|---|
| PX016 | 2331 | ACCGCCAGGTTCTTCAAGCAGGA | 47067814 (*Eremothecium gossypii*) |
| PX016 | 2332 | CTGTTCTTGAACTTGGCCAATGA | 90545177 (*Gloeophyllum trabeum*) |
| PX016 | 2333 | GGTTACATGTACACGGATTTG | 34447668 (*Cryphonectria parasitica*); 90545177 (*Gloeophyllum trabeum*); 39942327 (*Magnaporthe grisea*); 82608506 (*Phanerochaete chrysosporium*); 71006197 (*Ustilago maydis*) |
| PX016 | 2334 | GGCAAGCCCATCGACAAGGGCCC | 59283275 (*Blastocladiella emersonii*) |
| PX016 | 2335 | ATGGGGTGGGTGATGTCGTCGTTGGGCATGGTCA | 38353161 (*Hypocrea jecorina*) |
| PX016 | 2336 | ACCATGCCCAACGACGACATCACCCACCC | 59281308 (*Blastocladiella emersonii*) |
| PX016 | 2337 | TGCACAACAGGCAGATCTACCC | 107889579 (*Encephalitozoon cuniculi*) |
| PX016 | 2338 | CCGTCGCTATCTCGTCTCATGAA | 48521040 (*Coccidioides posadasii*) |

TABLE 6-AD

| Target ID | SEQ ID NO | Sequence * | Example Gi-number and species |
|---|---|---|---|
| AD001 | 2441 | CCCGCTGGTTTCATGGATGTT | 58259586 (*Cryptococcus neoformans*) |
| AD001 | 2442 | GACAACATCCATGAAACCAGCGGG | 21649877 (*Conidiobolus coronatus*) |
| AD001 | 2443 | TTCATGGATGTTGTCACCATTG | 90616000 (*Ophiostoma piliferum*) |
| AD001 | 2444 | GAAGAAGCCAAGTACAAGCTCTG | 110469512 (*Rhizopus oryzae*) |
| AD001 | 2445 | AAGAAGCCAAGTACAAGCTCTG | 110469518 (*Rhizopus oryzae*) |
| AD001 | 2446 | GCCAAGTACAAGCTCTGCAAGGT | 98996590 (*Spizellomyces punctatus*) |
| AD001 | 2447 | GCCAAGTACAAGCTCTGCAAGGTCA | 109743129 (*Allomyces macrogynus*) |
| AD001 | 2448 | AGTACAAGCTCTGCAAGGTCA | 71000466 (*Aspergillus fumigatus*); 67537247 (*Aspergillus nidulans*); 70823112 (*Aspergillus niger*); 40886470 (*Emericella nidulans*) |
| AD015 | 2449 | TATGGACCCCTGGAACTGGTAAAACC | 46349704 (*Paracoccidioides brasiliensis*) |
| AD016 | 2450 | TGCCCGTGTCCGAGGACATGCTGGGCCG | 109743322 (*Allomyces macrogynus*) |
| AD016 | 2451 | TGCCCGTGTCCGAGGACATGCTGGGCCGC | 59283275 (*Blastocladiella emersonii*) |
| AD016 | 2452 | CGTGTCCGAGGACATGCTGGGCCGCA | 90612905 (*Ophiostoma piliferum*) |
| AD016 | 2453 | ATGGGCGTCAACATGGAGACGGC | 59277641 (*Blastocladiella emersonii*) |
| AD016 | 2454 | TGGAGACGGCGCGCTTCTTCA | 90611376 (*Ophiostoma piliferum*) |
| AD016 | 2455 | TTCCTCAACCTGGCCAACGACCCCAC | 90611376 (*Ophiostoma piliferum*) |
| AD016 | 2456 | ACCATCGAGCGCATCATCACCCCGCGCCTCGC | 59281308 (*Blastocladiella emersonii*) |
| AD016 | 2457 | TCCACCATCTACGAGCGCGCTGG | 90368806 (*Aureobasidium pullulans*) |
| AD016 | 2458 | CTGACGATGCCCAACGACGACATCAC | 90611301 (*Ophiostoma piliferum*) |
| AD016 | 2459 | ATGCCCAACGACGACATCACCCA | 59281308 (*Blastocladiella emersonii*) |
| AD016 | 2460 | TGGGTGATGTCGTCGTTGGGCAT | 38353161 (*Hypocrea jecorina*) |

TABLE 7-LD

| Target ID | SEQ ID NO and DNA Sequence (sense strand) 5' → 3' of fragments and concatemer constructs |
|---|---|
| LD014_F1 | SEQ ID NO: 159<br>TCTAGAATGTTGAATCAGGCTCGATTGAAAGTATTGAAGGTTAGGGAAGATCACGTTCGTACCGTACTAGAGGAGGCGCGTAAA<br>CGACTTGGTCAGGTCACAAACGCCCGGG |

TABLE 7-LD-continued

| Target ID | SEQ ID NO and DNA Sequence (sense strand) 5' → 3' of fragments and concatemer constructs |
|---|---|
| LD014_F2 | SEQ ID NO: 160<br>TCTAGAAAGATCACGTTCGTACCGTACTAGAGGAGGCGCGTAAACGACTTGGTCAGGTCACAAACGCCCGGG |
| LD014_C1 | SEQ ID NO: 161<br>TCTAGAATGTTGAATCAGGCTCGATTGAAAGTATTGAAGGTTAGGGAAGATCACGTTCGTACCGTACTAGAGGAGGCGCGTAAA<br>CGACTTGGTCAGGTCACAAACGATGTTGAATCAGGCTCGATTGAAAGTATTGAAGGTTAGGGAAGATCACGTTCGTACCGTACTA<br>GAGGAGGCGCGTAAACGACTTGGTCAGGTCACAAACGATGTTGAATCAGGCTCGATTGAAAGTATTGAAGGTTAGGGAAGATCA<br>CGTTCGTACCGTACTAGAGGAGGCGCGTAAACGACTTGGTCAGGTCACAAACGCCCGGG |
| LD014_C2 | SEQ ID NO: 162<br>TCTAGAAAGATCACGTTCGTACCGTACTAGAGGAGGCGCGTAAACGACTTGGTCAGGTCACAAACGAAGATCACGTTCGTACCGT<br>ACTAGAGGAGGCGCGTAAACGACTTGGTCAGGTCACAAACGAAGATCACGTTCGTACCGTACTAGAGGAGGCGCGTAAACGACTT<br>GGTCAGGTCACAAACGAAGATCACGTTCGTACCGTACTAGAGGAGGCGCGTAAACGACTTGGTCAGGTCACAAACGAAGATCACG<br>TTCGTACCGTACTAGAGGAGGCGCGTAAACGACTTGGTCAGGTCACAAACGCCCGGG |

TABLE 8-LD

| Target ID | Primers Forward 5' → 3' | Primers Reverse 5' → 3' | dsRNA DNA Sequence (sense strand) 5' → 3' |
|---|---|---|---|
| LD001 | SEQ ID NO: 164<br>GCGTAATACGACTC<br>ACTATAGGGGCCCC<br>AAGAAGCATTTGAA<br>GCG<br>SEQ ID NO: 166<br>GGCCCCAAGAAGCA<br>TTTGAAGCG | SEQ ID NO: 165<br>CCTTTGGGGCCAGT<br>TTGCATC<br>SEQ ID NO: 167<br>GCGTAATACGACTC<br>ACTATAGGCCTTTG<br>GGGCCAGTTTGCAT<br>C | SEQ ID NO: 163<br>GGCCCCAAGAAGCATTTGAAGCGTTTGAATGCCCCAAAAGCATGGATGTTGG<br>ATAAATTGGGAGGTGTTTTCGCACCTCGCCCATCTACAGGACCTCACAAATTG<br>CGAGAGTCTTTGCCCTTGGTGATCTTCCTACGTAACCGATTGAAGTATGCTTT<br>GACTAACAGCGAAGTTACTAAGATTGTTATGCAAAGGTTAATCAAAGTAGATG<br>GAAAAGTGAGGACCGACTCCAATTACCCTGCTGGGTTTATGGATGTTATTACC<br>ATTGAAAAAACTGGTGAATTTTTCCGACTCATCTATGATGTTAAAGGACGATTT<br>GCAGTGCATCGTATTACTGCTGAGGAAGCAAAGTACAAACTATGCAAAGTCAG<br>GAGGATGCAAACTGGCCCCAAAGG |
| LD002 | SEQ ID NO: 169<br>GCGTAATACGACTC<br>ACTATAGGGTCCAC<br>GTCCAAGTTTTTATG<br>GGC<br>SEQ ID NO: 171<br>GTCCACGTCCAAGT<br>TTTTATGGGC | SEQ ID NO: 170<br>AAGCGATTAGAAAA<br>AAATCAGTTGC<br>SEQ ID NO: 172<br>GCGTAATACGACTC<br>ACTATAGGAAGCGA<br>TTAGAAAAAAATCAG<br>TTGC | SEQ ID NO: 168<br>GTCCACGTCCAAGTTTTTATGGGCTTTCTTAAGAGCTTCAGCTGCATTTTTCAT<br>AGATTCCAATACTGTGGTGTTCGTACTAGCTCCCTCCAGAGCTTCTCGTTGAA<br>GTTCAATAGTAGTTAAAGTGCCATCTATTTGCAACTGATTTTTTTCTAATCGCTT |
| LD003 | SEQ ID NO: 174<br>GCGTAATACGACTC<br>ACTATAGGCCCAGG<br>CGACCTTATGAAAA<br>GGC<br>SEQ ID NO: 176<br>CCCAGGCGACCTTA<br>TGAAAAGGC | SEQ ID NO: 175<br>GGTGACCACCACCG<br>AATGGAG<br>SEQ ID NO: 177<br>GCGTAATACGACTC<br>ACTATAGGGTGAC<br>CACCACCGAATGGA<br>G | SEQ ID NO: 173<br>GGTGACCACCACCGAATGGAGATTTGAGCGAGAAGTCAATATGCTTCTGGGA<br>ATCAAGTCTCACAATGAAGCTTGGAATATTCACGACCTGCTTACGAACCCTGA<br>TATGTCTTTGACGGACCAGCACACGAGCATGATGGATTGATTTGCAAGCCCC<br>AACTTGAAAACTTGTGTTTGGAGACGTCGTTCCAAGAAATCTTCAATCTTCAAA<br>CCCAAGACGTAATCAAGCTTCATACGGGTTTCATCCAACACTCCAATACGCAC<br>CAACCGACGAAGAAGAGCATTGCCTTCAAACAACCTGCGCTGATCTTTCTCTT<br>CCAAAGTCAGAAGTTCTCTGGCAGCTTTACGGATTTTTGCCAAGGTATACTTG<br>ACTCGCCACACTTCACGTTTGTTCCTAAGACCATATTCTCCTATGATTTTCAAC<br>TCCTGATCAAGACGTGCCTTTTCATAAGGTCGCCTGGG |
| LD006 | SEQ ID NO: 179<br>GCGTAATACGACTC<br>ACTATAGGGGTGTT<br>GGTTGCTTCTGGTGT<br>TG<br>SEQ ID NO: 181<br>GGTGTTGGTTGCTT<br>CTGGTGTG | SEQ ID NO: 180<br>GCTTCGATTCGGCA<br>TCTTTATAGG<br>SEQ ID NO: 182<br>GCGTAATACGACTC<br>ACTATAGGGCTTCG<br>ATTCGGCATCTTTAT<br>AGG | SEQ ID NO: 178<br>GGTGTTGGTTGCTTCTGGTGTGGTGGAATACATCGACACTCTTGAAGAAGAAA<br>CTGTCGTGATGATGAATCCTGAGGATCTTCGGCAGGACAAAGAAATATGCT<br>TATTGTACGACCTACACCCACTGCGAAATCCACCCGGCCATGATCTTGGGCG<br>TTTGCGCGTCTATTATACCTTTCCCCGATCATAACCAGAGCCCAAGGAACACC<br>TACCAGAGCGCTATGGGTAAGCAAGCTATGGGGGTCTACATTACGAATTTCCA<br>CGTGCGGATGGACACCCTGGCCCACGTGCTATACTACCCGCACAAACCTCTG<br>GTCACTACCAGGTCTATGGAGTATCTGCGGTTCAGAGAATTACCAGCCGGGA<br>TCAACAGTATAGTTGCTATTGCTTGTTATACTGGTTATAATCAAGAAGATTCTG<br>TTATTCTGAACGCGTCTGCTGTGGAAAGAGGATTTTTCCGATCCGTGTTTTAT<br>CGTTCCTATAAAGATGCCGAATCGAAGC |
| LD007 | SEQ ID NO: 184<br>GCGTAATACGACTC<br>ACTATAGGGACTGG<br>CGGTTTTGAACACC<br>C<br>SEQ ID NO: 186<br>GACTGGCGGTTTTG<br>AACACCC | SEQ ID NO: 185<br>CCTTTCAATGTCCAT<br>GCCACG<br>SEQ ID NO: 187<br>GCGTAATACGACTC<br>ACTATAGGCCTTTCA<br>ATGTCCATGCCACG | SEQ ID NO: 183<br>GACTGGCGGTTTTGAACACCCTTCAGAAGTTCAGCACGAATGTATTCCTCAAG<br>CTGTCGTTGCATGGACATTTTATGTCAAGCCAAATCTGGTATGGGCAAAAG<br>GCAGTGTTTGTTCTGGCGACACTGCAACAATTGGAACCAGCGGACAATTG<br>TTTACGTTTTGGTGATGTGTCACACTCGTGAACTGGCTTTCCAAATCAGCAAA<br>GAGTACGAGAGGTTCAGTAAATATATGCCCAGTGTCAAGGTGGGCGTCTTTTT<br>CGGAGGAATGCCTATTGCTAACGATGAAGAAGTATTGAAAAACAAATGTCCAC<br>ACATTGTGTGGGACGCCTGGGCGTATTTGGCGCTTGTCAAGCTCTAGGAA<br>GCTAGTCCTCAAGAACCTGAAACACTTCATTCTTGATGAGTGCGATAAAATGT<br>TAGAACTGTTGGATATGAGGAGACGTCCAGGAAATCTACAGAAACACCCC<br>TCACACCAAGCAAGTGATGATGTTCAGTGCCACACTCAGCAAAGAAATCAGG<br>CCGGTGTGCAAGAATTCATGCAAGATCCAATGGAGGTGTATGTAGACGATG |

TABLE 8-LD-continued

| Target ID | Primers Forward 5' → 3' | Primers Reverse 5' → 3' | dsRNA DNA Sequence (sense strand) 5' → 3' |
|---|---|---|---|
| | | | AAGCCAAATTGACGTTGCACGGATTACAACAGCATTACGTTAAACTCAAAGAA<br>AATGAAAAGAATAAAAAATTATTTGAGTTGCTCGATGTTCTCGAATTTAATCAG<br>GTGGTCATTTTTGTGAAGTCCGTTCAAAGGTGTGTGGCTTTGGCACAGTTGCT<br>GACTGAACAGAATTTCCCAGCCATAGGAATTCACAGAGGAATGGACCAGAAA<br>GAGAGGTTGTCTCGGTATGAGCAGTTCAAAGATTTCCAGAAGAGAATATTGGT<br>AGCTACGAATCTCTTTGGGCGTGGCATGGACATTGAAAGG |
| LD010 | SEQ ID NO: 189<br>GCGTAATACGACTC<br>ACTATAGGGCTTGTT<br>GCCCCCGAATGC<br>SEQ ID NO: 191<br>GCTTGTTGCCCCCG<br>AATGC | SEQ ID NO: 190<br>CTATCGGGTTGGAT<br>GGAACTCG<br>SEQ ID NO: 192<br>GCGTAATACGACTC<br>ACTATAGGCTATCG<br>GGTTGGATGGAACT<br>CG | SEQ ID NO: 188<br>GCTTGTTGCCCCCGAATGCCTTGATAGGGTTGATTACCTTTGGGAAGATGGTC<br>CAAGTGCACGAACTAGGTACCGAGGGCTGCAGCAAATCTTACGTTTTCCGAG<br>GGACGAAAGACCTCACAGCTAAGCAAGTTCAAGAGATGTTGGAAGTGGGCAG<br>AGCCGCAGTAAGTGCTCAACCTGCTCCTCAACAACCAGGACAACCCATGAGG<br>CCTGGAGCACTCCAGCAAGCTCCTACGCCACCAGGAAGCAGGTTCCTTCAAC<br>CCATCTCGAAATGCGACATGAACCTCACTGATCTTATTGGAGAGTTGCAAAGA<br>GACCCATGGCCTGTCCACCAAGGCAAATGCGCCCTTAGATCGACCGGGACA<br>GCTTTATCGATAGCCATTGGGTTGTTGGAGTGCACATACGCCAATACTGGTGC<br>CAGGGTCATGCTATTCGTTGGAGGACCTTGCTCTCAAGGCCCTGGTCAAGTC<br>TTGAATGATGATCTGAAGCAACCTATCAGATCTCACCACGACATCCAAAAAGA<br>CAATGCCAAATACATGAAGAAAGCAATCAAGCACTATGATAATTTAGCGATGA<br>GAGCAGCAACGAATGGCCACTGCGTTGACATATATTCATGCGCTTTGGATCA<br>GACAGGATTGATGGAGATGAAACAGTGTTGTAATTCAACAGGGGACATATG<br>GTCATGGGCGACTCGTTCAATTCTTCCCTGTTCAAGCAAACGTTCCAGCGCAT<br>ATTTTCGAAAGATCAGAAAAACGAGCTGAAGATGGCATTTAATGGTACTCTGG<br>AGGGTCAAGTGTTCCAGGGAGTTGAAAATTCAAGGCGGTATTGGATCTTGTGT<br>TTCGTTGAATGTGAAGAATCCTTTGGTTTCCGACACCGAAATAGGAATGGGTA<br>ACACGGTCCAGTGGAAAATGTGTACGGTAACTCCAAGTACTACCATGGCCTT<br>GTTCTTCGAGGTCGTCAACCAACATTCCGCTCCCATACCTCAAGGGGGAAGG<br>GGCTGCATACAGTTCATCACGCAATATCAGCATGCTAGTGGCCAGAAGAGGA<br>TCCGAGTAACGACAGTTGCTAGAAACTGGGCCGATGCTTCCGCTAATATACAT<br>CATGTCAGTGCTGGATTCGATCAGGAGGCAGCCGCAGTGATAATGGCGAGGA<br>TGGCAGTTTACAGAGCGGAATCAGACGATAGCCCTGATGTTTTGAGATGGGT<br>CGATAGGATGTTGATACGTCTGTGCCAGAAATTCGGCGAATATAACAAGGAC<br>GACCCGAATTCGTTCCGCTTGGGCGAAAACTTCAGCCTCTACCCGCAGTTCA<br>TGTACCATTTGAGAAGGTCACAGTTCCTGCAGGTGTTTAACAATTCTCCCGAC<br>GAAACGTCCTTCTACAGGCACATGCTTATGCGCGAAGACCTCACGCAGTCGC<br>TGATCATGATCCAGCCGATACTCTACAGCTACAGTTTCAATGGACCACCAGAA<br>CCTGTGCTTTTGGATACGAGTTCCATCCAACCCGATAG |
| LD011 | SEQ ID NO:194<br>GCGTAATACGACTC<br>ACTATAGGGCCATA<br>GGAAAGGCTTCTCA<br>AAG<br>SEQ ID NO: 196<br>GCCATAGGAAAGGC<br>TTCTCAAAG | SEQ ID NO: 195<br>GGAAAAACGACATT<br>TGTGAAACGTC<br>SEQ ID NO: 197<br>GCGTAATACGACTC<br>ACTATAGGGGAAAA<br>ACGACATTTGTGAAA<br>CGTC | SEQ ID NO: 193<br>GCCATAGGAAAGGCTTCTCAAAGTTGTAGTTAGATTTGGCAGAGATATCATAG<br>TACTGCAAATTCTTCTTCCTATGAAAGACAATACTTTTCGCTTTTACTTTTCTGT<br>CTTTGATGTCAACCTTGTTCCCGCAAAGTACTATCGGGATATTTTCACAGACTC<br>TGACAGATCTCTGTGCCAATTTGGTACATTCTTGTATGTAACTCTGGAAGTTA<br>CATCAAACATGATAATAGCACACTGTCCCTGAATGTAATATCCATCACGGAGA<br>CCACCAAACTTCTCCTGACCGGCAGTGTCCCATACATTGAACCGAATAGGGC<br>CCCTGTTTGTATGGAAGACCAGAGGATGGACTTCAACTCCCAAAGTAGCTACA<br>TATCTTTTTTCAAATTCACCAGTCATATGACGTTTCACAAATGTCGTTTTTCC |
| LD014 | SEQ ID NO: 199<br>GCGTAATACGACTC<br>ACTATAGGTTTCATT<br>GAACAAGAGGCAAA<br>CG<br>SEQ ID NO: 201<br>TTTCATTGAACAAGA<br>GGCAAACG | SEQ ID NO: 200<br>GCGAAATCAGCTCC<br>AGACGAGC<br>SEQ ID NO: 202<br>GCGTAATACGACTC<br>ACTATAGGGCGAAA<br>TCAGCTCCAGACGA<br>GC | SEQ ID NO: 198<br>TTTCATTGAACAAGAGGCAAACGAAAAGGCAGAAGAAATCGATGCCAAGGCC<br>GAGGAAGAATTTAATATTGAAAAGGGGCGCCTTGTTCAGCAACAACGTCTCAA<br>GATTATGGAATATTATGAGAAGAAAGAGAAACAGGTCGAACTCCAGAAAAAAA<br>TCCAATCGTCTAACATGTTGAATCAGGCTCGATTGAAAGTATTGAAGGTTAGG<br>GAAGATCACGTTCGTACCGTACTAGAGGAGGCGCGTAAACGACTTGGTCAGG<br>TCACAAACGACCAGGGAAAATATTCCCAAATCTGGAAAGCCTCATTTTGCAG<br>GGATTATATCAGCTTTTTGAGAAAGATGTTACCATTCGAGTTCGGCCCCAGGA<br>CCGAGAACTGGTCAAATCCATCATTCCCACCGTCACGAACAAGTATAAAGATG<br>CCACCGGTAAGGACATCCATCTGAAAATTGATGACGAAATCCATCTGTCCCAA<br>GAAACCACCGGGGAATCGACCTGCTGGCGCAGAAAAACAAAATCAAGATCA<br>GCAATACTATGGAGGCTCGTCTGGAGCTGATTTCGC |
| LD014_F1 | SEQ ID NO: 204<br>GCGTAATACGACTC<br>ACTATAGGATGTTGA<br>ATCAGGCTCGATTG<br>SEQ ID NO: 206<br>ATGTTGAATCAGGC<br>TCGATTG | SEQ ID NO: 205<br>CGTTTGTGACCTGA<br>CCAAGTC<br>SEQ ID NO: 207<br>GCGTAATACGACTC<br>ACTATAGGCGTTTGT<br>GACCTGACCAAGTC | SEQ ID NO: 203<br>ATGTTGAATCAGGCTCGATTGAAAGTATTGAAGGTTAGGGAAGATCACGTTCG<br>TACCGTACTAGAGGAGGCGCGTAAACGACTTGGTCAGGTCACAAACG |
| LD014_F2 | SEQ ID NO: 209<br>GCGTAATACGACTC<br>ACTATAGGAAGATC<br>ACGTTCGTACCGTA<br>C<br>SEQ ID NO: 211<br>AAGATCACGTTCGT<br>ACCGTAC | SEQ ID NO: 210<br>CGTTTGTGACCTGA<br>CCAAG<br>SEQ ID NO: 212<br>GCGTAATACGACTC<br>ACTATAGGCGTTTGT<br>GACCTGACCAAG | SEQ ID NO: 208<br>AAGATCACGTTCGTACCGTACTAGAGGAGGCGCGTAAACGACTTGGTCAGGT<br>CACAAACG |

TABLE 8-LD-continued

| Target ID | Primers Forward 5' → 3' | Primers Reverse 5' → 3' | dsRNA DNA Sequence (sense strand) 5' → 3' |
|---|---|---|---|
| LD014_C1 | | | SEQ ID NO: 213<br>AATGTTGAATCAGGCTCGATTGAAAGTATTGAAGGTTAGGGAAGATCACGTTC<br>GTACCGTACTAGAGGAGGCGCGTAAACGACTTGGTCAGGTCACAAACGATGT<br>TGAATCAGGCTCGATTGAAAGTATTGAAGGTTAGGGAAGATCACGTTCGTACC<br>GTACTAGAGGAGGCGCGTAAACGACTTGGTCAGGTCACAAACGATGTTGAAT<br>CAGGCTCGATTGAAAGTATTGAAGGTTAGGGAAGATCACGTTCGTACCGTACT<br>AGAGGAGGCGCGTAAACGACTTGGTCAGGTCACAAACGC |
| LD014_C2 | | | SEQ ID NO: 214<br>AAAGATCACGTTCGTACCGTACTAGAGGAGGCGCGTAAACGACTTGGTCAGG<br>TCACAAACGAAGATCACGTTCGTACCGTACTAGAGGAGGCGCGTAAACGACT<br>TGGTCAGGTCACAAACGAAGATCACGTTCGTACCGTACTAGAGGAGGCGCGT<br>AAACGACTTGGTCAGGTCACAAACGAAGATCACGTTCGTACCGTACTAGAGG<br>AGGCGCGTAAACGACTTGGTCAGGTCACAAACGAAGATCACGTTCGTACCGT<br>ACTAGAGGAGGCGCGTAAACGACTTGGTCAGGTCACAAACGC |
| LD015 | SEQ ID NO: 216<br>GCGTAATACGACTC<br>ACTATAGGGCGCCGG<br>AGAGTTTTTGTCAGC<br>SEQ ID NO: 218<br>CGCCGGAGAGTTTT<br>TGTCAGC | SEQ ID NO: 217<br>CTATCGGCGTGAAG<br>CCCCC<br>SEQ ID NO 219<br>GCGTAATACGACTC<br>ACTATAGGCTATCG<br>GCGTGAAGCCCCC | SEQ ID NO: 215<br>CGCCGGAGAGTTTTTGTCAGCTTCTTCAAAAGCTTTGCGCAAGTTACTCTCAG<br>ACTCGCCAGCGAGTTTGCTCATGATCTCCGGCCCGTTTATCAAGAAGAAGAA<br>CGCCCCAGTCTCATTAGCCACGGCGCGAGCAATCAGGGTCTTACCCGTACCA<br>GGGGGACCATACAGCAGTATACCCCTAGGGGGCTTCACGCCGATAG |
| LD016 | SEQ ID NO: 221<br>GCGTAATACGACTC<br>ACTATAGGGGCATA<br>GTCAATATAGGAATC<br>TGGGTG<br>SEQ ID NO: 223<br>GGCATAGTCAATATA<br>GGAATCTGGGTG | SEQ ID NO: 222<br>GGTAATCCTCGAAG<br>ATGTTAAGTTCC<br>SEQ ID NO: 224<br>GCGTAATACGACTC<br>ACTATAGGGTAAT<br>CCTCGAAGATGTTA<br>AGTTCC | SEQ ID NO: 220<br>GGCATAGTCAATATAGGAATCTGGGTGATGGATCCGTTACGTCCTTCAACACG<br>GCCGGCACGTTCATAGATGGTAGCTAAATCGGTGTACATGTAACCTGGGAAA<br>CCACGACGACCAGGCACCTCTTCTCTGGCAGCAGATACCTCACGCAAAGCTT<br>CTGCATACGAAGACATATCTGTCAAGATGACCAAGACGTGCTTCTCACATTGG<br>TAAGCCAAGAATTCGGCAGCTGTCAAAGCCAGACGAGGTGTAATAATTCTTTC<br>AATGGTAGGATCGTTGGCCAAATTCAAGAACAGGCAGACATTCTCCATAGAAC<br>CGTTCTCTTCGAAATCCTGTTTGAAGAACCTAGCTGTTTCCATGTTAACACCCA<br>TAGCAGCGAAAACAATAGCAAAGTTATCTTCATGATCATCAAGTACAGATTTAC<br>CAGGAATCTTGACTAAACCAGCCTGTCTACAGATCTGGGCAGCAATTTCATTG<br>TGAGGCAGACCAGCTGCAGAGAAAATGGGGATCTTCTGACCACGAGCAATGG<br>AGTTCATCACGTCAATAGCTGTAATACCCGTCTGGATCATTTCCTCAGGATAG<br>ATACGGGACCACGGATTGATTGGTTGACCCTGGATGTCCAAGAAGTCTTCAG<br>CCAAAATTGGGGACCTTTGTCGATGGGTTTTCCTGATCCATTGAAAACACGT<br>CCCAACATATCTTCAGAAACAGGAGTCCTCAAAATATCTCCTGTGAATTCACAA<br>GCGGTGTTTTGGCGTCGATTCCTGATGTGCCCTCGAACACTTGAACCACAG<br>CTTTTGACCCACTGACTTCCAGAACTTGTCCCGAACGTATAGTGCCATCAGCC<br>AGTTTGAGTTGTACGATTTCATTGTACTTGGGGAACTTAACATCTTCGAGGATT<br>ACC |
| LD018 | SEQ ID NO: 226<br>GCGTAATACGACTC<br>ACTATAGGGGAGTC<br>GCAGAAATACGAGA<br>GCAC<br>SEQ ID NO: 228<br>GGAGTCGCAGAAAT<br>ACGAGAGCAC | SEQ ID NO: 227<br>GTAGAGGCTCCACC<br>GTCAATCGC<br>SEQ ID NO: 229<br>GCGTAATACGACTC<br>ACTATAGGTAGAG<br>GCTCCACCGTCAAT<br>CGC | SEQ ID NO: 225<br>GGAGTCGCAGAAATACGAGAGCACCTTCTCGAACAACCAAGCCTCCTTGAGG<br>GTAAAACAAGCCCAGTCTGAGGACTCGGGACACTACACTTTGTTGGCGGAGA<br>ACCCTCAAGGCTGCATAGTGTCATCTGCTTACTTAGCCATAGAACCGGTAACC<br>ACCCAGGAAGGGTTGATCCACGAGTCCACCTTCAAGCAGCAACAGACCGAAA<br>TGGAGCAAATCGACACCAGCAAGACCTTGGCGCCTAACTTCGTCAGGGTTTG<br>CGGGGATAGAGACGTGACCGAGGGCAAGATGACCCGCTTCGACTGTCGCGT<br>CACTGGTCGTCCTTATCCAGACGTGACATGGTACATAAACGGTCGACAAGTCA<br>CCGACGACCACAACCACAAGATTTTGGTTAACGAATCCGGAAACCATGCCCT<br>GATGATCACCACCGTGAGCAGGAACGACTCAGGAGTAGTGACCTGCGTCGC<br>CAGGAACAAGACGGGAGAAACCTCCTTCCAGTGCAACCTTAACGTCATCGAA<br>AAGGAACAGGTAGTCGCGCCCAAGTTCGTGGAGAGATTTACCACAGTCAACG<br>TGGCAGAAGGAGAACCAGTGTCTCTGCGCGTAGAGCTGTTGGCACGCCGG<br>TGCCGCGAATCACTTGGCAGAGGGACGGGGCGCCCCTAGCCAGCGGGCCC<br>GACGTTCGCATCGCGATTGACGGTGGAGCCTCTAC |
| LD027 | SEQ ID NO: 231<br>GCGTAATACGACTC<br>ACTATAGGGGGAGC<br>AGACGATCGGTTGG<br>SEQ ID NO: 233<br>GGGAGCAGACGATC<br>GGTTGG | SEQ ID NO: 232<br>TCGGACAGACTCGT<br>TCATTTCCC<br>SEQ ID NO: 234<br>GCGTAATACGACTC<br>ACTATAGGTCGGAC<br>AGACTCGTTCATTTC<br>CC | SEQ ID NO: 230<br>GGGAGCAGACGATCGGTTGGTTAAAATCTGGGACTATCAAAACAAAACGTGT<br>GTCCAAACCTTGGAGGACACGCCCAAAACGTAACCGCGTTTGTTTCCACC<br>CTGAACTACCTGTGGCTCTCACAGGCAGCGAAGATGGTACCGTTAGAGTTTG<br>GCATACGAATACACACAGATTAGAGAATTGTTTGAATTATGGGTTCGAGAGAG<br>TGTGGACCATTTGTTGCTTGAAGGGTTCGAATAATGTTTCTCTGGGGTATGAC<br>GAGGGCAGTATATTAGTGAAAGTTGGAAGAGAAGAACCGGCAGTTAGTATGG<br>ATGCCAGTGGCGGTAAAATTTGGGCAAGGCACTCGGAATTACAACAAGC<br>TAATTTGAAGGCGCTGCCAGAAGGTGGAGAAATAAGAGATGGGGAGCGTTTA<br>CCTGTCTCTGTAAAAGATATGGGAGCATGTGAAATATACCCTCAAACAATCCA<br>ACATATCGAATGGAAGATTCGTTGTAGTATGCGGAGACGGGAATATATCA<br>TTTACACAGCGATGGCTCTACGAACAAGGCTTTTGGAAGCGCTCAAGAGTTT<br>GTCTGGGCTCAGGACTCCAGCGAGTATGCCATTCGCGAGTCTGGTTCCACAA<br>TTCGGATATTCAAAAACTTCAAAGAAAGGAAGAACTTCAAGTCGGATTTCAGC<br>GCGGAAGGAATCTACGGGGGTTTTCTCTTGGGGATTAAATCGGTGTCCGTT<br>TAACGTTTTACGATTGGGAAACTTTGGACTTGGTGAGACGGATTGAAATACAA |

TABLE 8-LD-continued

| Target ID | Primers Forward 5' → 3' | Primers Reverse 5' → 3' | dsRNA DNA Sequence (sense strand) 5' → 3' |
|---|---|---|---|
| | | | CCGAGGGCGGTTTATTGGTCTGACAGTGGAAAATTAGTCTGTCTCGCAACGG AGGACAGCTACTTCATCCTTTCTTATGATTCGGAGCAAGTTCAGAAGGCCAGG GAGAACAATCAAGTCGCAGAGGATGGCGTAGAGGCCGCTTTCGATGTGTTGG GGGAAATGAACGAGTCTGTCCGA |
| gfp | SEQ ID NO: 236 GCGTAATACGACTC ACTATAGGAGATAC CCAGATCATATGAAA CGG SEQ ID NO: 238 AGATACCCAGATCA TATGAAACGG | SEQ ID NO: 237 CAATTTGTGTCCAAG AATGTTTCC SEQ ID NO: 239 GCGTAATACGACTC ACTATAGGCAATTTG TGTCCAAGAATGTTT CC | SEQ ID NO: 235 AGATACCCAGATCATATGAAACGGCATGACTTTTTCAAGAGTGCCATGCCCGA AGGTTATGTACAGGAAAGAACTATATTTTTCAAAGATGACGGGAACTACAAGA CACGTAAGTTTAAACAGTTCGGTACTAACTAACCATACATATTTAATTTTCAG GTGCTGAAGTCAAGTTTGAAGGTGATACCCTTGTTAATAGAATCGAGTTAAAA GGTATTGATTTTAAAGAAGATGGAAACATTCTTGGACACAAATTG |

TABLE 8-PC

| Target ID | Primers Forward 5' → 3' | Primers Reverse 5' → 3' | dsRNA DNA Sequence (sense strand) 5' → 3' |
|---|---|---|---|
| PC001 | SEQ ID NO: 474 GCATGGATGTTGGA CAAATTGGG SEQ ID NO: 476 GCGTAATACGACTC ACTATAGGGCATGG ATGTTGGACAAATTG GG | SEQ ID NO: 475 GCGTAATACGACTC ACTATAGGAGATTCA AATTTGATGTAGTCA AGAATTTTAG SEQ ID NO: 477 AGATTCAAATTTGAT GTAGTCAAGAATTTT AG | SEQ ID NO: 473 GCATGGATGTTGGACAAATTGGGGGGTGTCTTCGCCCCTCGTCCATCCACCGGG CCTCACAAGTTGCGCGAATCCCTGCCTTTAGTGATTTTCCTTCGTAACAGGCTGAA GTATGCCCTTACAAACAGTGAAGTCACTAAAATTGTCATGCAAAGGTTGATCAAAG TTGATGGTAAAGTGAGGACTGATTCTAATTACCCTGCTGGTTTCATGGATGTCATT ACTATTGAGAAGACTGGTGAATTTTTCCGTCTGATCTATGATGTTAAAGGAAGATT TGCTGTGCACCGTATTACAGCTGAAGAGGCAAAATACAAGTTGTGTAAAGTAAGG AGAGTCCAAACTGGTCCCAAAGGAATCCCATTTTTGGTAACACATGATGGCAGAA CCATTCGTTACCCTGACCCCAACATCAAAGTGAATGACACAATTCAAATGGAAATT GCTACATCTAAAATTCTTGACTACATCAAATTTGAATCT |
| PC003 | SEQ ID NO: 479 CCCTAGACGTCCCT ATGAAAAGGCCC SEQ ID NO: 481 GCGTAATACGACTC ACTATAGGCCCTAG ACGTCCCTATGAAA AGGCCC | SEQ ID NO: 480 GCGTAATACGACTC ACTATAGGTTGACA CGGCCAGGTCGGC CACC SEQ ID NO: 482 TTGACACGGCCAGG TCGGCCACC | SEQ ID NO: 478 CCCTAGACGTCCCTATGAAAAGGCCCGTCTGGATCAGGAATTGAAAATTATCGGC GCCTTTGGTTTACGAAACAAACGTGAAGTGTGGAGAGTAAAGTACACTTTGGCTA AAATCCGTAAAGCTGCTCGTGAACTGCTCACCCTAGAAGAAAAGAGCCTAAAAG ATTGTTTGAAGGTAATGCACTTCTACGTCGTTTGGTGCAATTGGTGTTCTGGATG AGAACAGGATGAAGCTTGATTATGTTTGGGTCTGAAAATTGAAGATTTCTTGGAA AGAAGGCTCCAAACTCAGGTGTTCAAATCTGGTCTGGCAAAGTCAATTCATCATG CTAGAGTACTGATTAGGCAGAGACACATCCGGGTGCGCAAGCAGGTGGTGAACA TCCCCTCGTTCATCGTGCGGCTGGACTCGCAGAAGCACATCGACTTCTCCCTGAA GTCGCCCTTCGGGGGTGGCCGACCTGGCCGTGTCAA |
| PC005 | SEQ ID NO: 484 ATCCTAATGAAATCA ACGAAATCGCC SEQ ID NO: 486 GCGTAATACGACTC ACTATAGGATCCTAA TGAAATCAACGAAAT CGCC | SEQ ID NO: 485 GCGTAATACGACTC ACTATAGGTTCCCTA CGTTCCCTGGCCTG CTTC SEQ ID NO: 487 TTCCCTACGTTCCCT GGCCTGCTTC | SEQ ID NO: 483 ATCCTAATGAAATCAACGAAATCGCCAACACCAACTCAAGACAAAACATCCGTAAG CTCATCAAGGATGGTCTTATCATCAAGAAGCCAGTGGCAGTACACTCTAGGGCCC GTGTACGCAAGAACACTGAAGCTAGAAGGAAGGGAAGGCATTGTGGATTTGGAAA GAGGAAGGGTACGGCAAATGCCCGTATGCCTCAAAAGGAACTGTGGGTGCAGCG CATGCGCGTCCTCAGGCGCCTCCTCAAAAAGTACAGGGAGGCCAAGAAAATCGA CCGCCATCTTTACCACGCCCTGTACATGAAAGCGAAGGGTAACGTGTTCAGGAAC AAGAGGGTCCTTATGGAGTACATCCACAAGAAGAAGGCAGAGAAGGCCAGGGCC AAGATGCTGTCTGACCAGGCTAACGCCAGGAGATTGAAGGTGAAGCAGGCCAGG GAACGTAGGGAA |
| PC010 | SEQ ID NO: 489 GCTCAGCCTATTAC CGCCCAACGC SEQ ID NO: 491 GCGTAATACGACTC ACTATAGGGCTCAG CCTATTACCGCCCA ACGC | SEQ ID NO: 490 GCGTAATACGACTC ACTATAGGATGGAA AATGAGTATCTGGA AGAAAG SEQ ID NO: 492 ATGGAAAATGAGTAT CTGGAAGAAAG | SEQ ID NO: 488 GCTCAGCCTATTACCGCCCAACGCGTTGATTGGATTGATCACGTTCGGAAAAATG GTGCAAGTCCACGAACTGGGTACCGAAGGCTGCAGCAAGTCGTACGTGTTCTGT GGAACGAAAGATCTCCACCGCCAAGCAAGTCCAGGAGATGTTGGGCATTGGAAAA GGGTCACCAAGTCCCCAACAACAGCCAGGGCAACCTGGGCGGCCAGGGCAGAAT CCCCAAGCTGCCCCTGTACCACCGGGGAGCAGATTCTTGCAGCCCGTGTCAAAA TGCGACATGAACTTGACAGATCTGATCGGGGAGTTGCAGAAAGACCCTTGGCCC GTACATCAGGGCAAAAGACCTCTTAGATCCACAGGCGCAGCATTGTCCATCGCTG TCGGCCTCTTAGAATGCACCTATCCGAATACGGGTGGCAGAATCATGATATTCTTA GGAGGACCATGCTCTCAGGGTCCGGCCAGGTGTTGAACGACGATTTGAAGCAG CCCATCAGGTCCCATCATGACATACACAAAGACAATGCCAAGTACATGAAGAAGG CTATCAAACATTACGATCACTTGGCAATGCGAGCTGCCACCAACAGCCATTGCAT CGACATTTACTCCTGGATCAGACGGGACTGATGGAGATGAAGCAGTG CTGCAATTCCACCGGAGGGCACATGGTCATGGGCGATTCCTTCAATTCCTCTCTA TTCAAACAAACCTTCCAGCGAGTGTTCTCAAAAGACCCGAAGAACGACCTCAAGA TGGCGTTCAACGCCACCTTGGAGGTGAAGTGTTCCAGGGAGTTAAAAGTCCAAG GGGGCATCGGCTCTGTGCGTCCTTGAACGTTAAAAGCCCTCTGTTTTCCGATAC GGAACTAGGCATGGGGAATACTGTGCAGTGGAAACTTTGCTACGTTGGCGCCGAG CTCTACTGTGGCGCTGTTCTTCGAGGTGGTTAACCAGCATTCGGCGCCCATACCA CAGGGAGGCAGGGGCTGCATCCAGCTCATCACCCAGTATCAGCACGCGAGCGG GCAAAGGAGGATCAGAGTGACCACGATTGCTAGAAATTGGGCGGACGCTACTGC CAACATCCACCACATTAGCGCTGGCTTCGACCAAGAAGCGGCGGCAGTTGTGAT |

TABLE 8-PC-continued

| Target ID | Primers Forward 5' → 3' | Primers Reverse 5' → 3' | dsRNA DNA Sequence (sense strand) 5' → 3' |
|---|---|---|---|
| | | | GGCCCGAATGGCCGGTTACAAGGCGGAATCGGACGAGACTCCCGACGTGCTCA GATGGGTGGACAGGATGTTGATCAGGCTGTGCCAGAAGTTCGGAGAGTACAATA AAGACGATCCGAATTCGTTCAGGTTGGGGGAGAACTTCAGTCTGTATCCGCAGTT CATGTACCATTTGAGACGGTCGCAGTTTCTGCAGGTGTTCAATAATTCTCCTGATG AAACGTCGTTTTATAGGCACATGCTGATGCGTGAGGATTTGACTCAGTCTTTTGATC ATGATCCAGCCGATTTTGTACAGTTACAGCTTCAACGGGCCGCCCGAGCCTGTGT TGTTGGACACAAGCTCTATTCAGCCGGATAGAATCCTGCTCATGGACACTTTCTTC CAGATACTCATTTTCCAT |
| PC014 | SEQ ID NO: 494 CTGATGTTCAAAAAC AAATCAAACACATG SEQ ID NO: 496 GCGTAATACGACTC ACTATAGGCTGATG TTCAAAAACAAATCA AACACATG | SEQ ID NO: 495 GCGTAATACGACTC ACTATAGGTGAGCG ATCAGATCCAACCTA GCCTCC SEQ ID NO: 497 TGAGCGATCAGATC CAACCTAGCCTCC | SEQ ID NO: 493 CTGATGTTCAAAAACAAATCAAACACATGATGGCTTTCATTGAACAAGAAGCCAAT GAGAAAGCAGAAGAAATTGATGCCAAGGCAGAGGAGGAATTCAACATTGAAAAAG GGCGTTTGGTCCAGCAACAGAGACTCAAGATCATGGAGTACTACGAGAAAAAGGA GAAGCAAGTCGAACTTCAAAAGAAAATTCAGTCCTCTAATATGTTGAATCAGGCTC GTTTGAAGGTGCTGAAAGTGAGAGAGGACCATGTCAGAGCAGTCCTGGAGGATG CTCGTAAAAGTCTTGGTGAAGTAACCAAAGACCAAGGAAAATACTCCCAAATTTTG GAGAGCCTAATCCTACAAGGACTGTTCCAGCTGTTCGAGAAGGAGGTGACGGTC CGCGTGAGACCGCAAGACAGGGACCTGGTCAGGTCCATCCTGCCCAACGTCGCT GCCAAATACAAGGACGCCACCGGCAAAGACATCCTACTCAAGGTGGACGATGAG TCGCACCTGTCTCAGGAGATCACCGGAGGCGTCGATTTGCTCGCTCAGAAGAAC AAGATCAAGATCAGCAACACGATGGAGGCTAGGTTGGATCTGATCGCTCA |
| PC016 | SEQ ID NO: 499 ACTGGTCATTCTTGA GGATGTCAAGT SEQ ID NO: 501 GCGTAATACGACTC ACTATAGGACTGGT CATTCTTGAGGATGT CAAGT | SEQ ID NO: 500 GCGTAATACGACTC ACTATAGGTTGGGC ATAGTCAAGATGGG GATCTGC SEQ ID NO: 502 TTGGGCATAGTCAA GATGGGGATCTGC | SEQ ID NO: 498 ACTGGTCATTCTTGAGGATGTCAAGTTTCCAAAATTCAATGAAATTGTCCAGCTCA AATTGGCAGATGGAACTCTACGATCTGGACAAGTTTTGGAAGTCAGTGGATCAAA GGCAGTTGTTCAGGTATTTGAAGGCACATCAGGTATTGATGCTAAGAACACGGTG TGTGAGTTCACTGGAGATATTCTAAGAACTCCAGTATCAGAAGATATGCTGGGAC GTGTCTTCAATGGATCAGGAAAACCCATTGATAAAGGTCCCCCGATCCTGGCTGA GGACTACCTCGACATCCAAGGACAGCCGATCAACCCGTGGTCGCGTATTTATCCC GAGGAAATGATCCAGACTGGGATCACGGCCATCGACGTGATGAACTCTATCGCCA GAGGGCAGAAGATTCCGATCTTCTCCGCGCTGGGCTGCCCCACAATGAGATTG CAGCCCAGATTTGTAGGCAGGCTGGCTTGGTCAAAGTACCTGGCAAGTCTGTGCT GGATGACCATGAAGACAACTTTGCTATTGTGTTTGCTGCTATGGGTGTCAACATG GAAACTGCCAGGTTCTTCAAGCAGGACTTCGAAGAGAACGGCTCGATGGAGAAC GTGTGTCTGTTCTTGAACTTGGCCAACGATCCGACCATCGACGCATCATCACGC CGCGTTTGGCTCTGACGGCCGCCGAATTCTTGGCTACCAGTGCGAGAAGCACG TGCTGGTCATCTTGACCGACATGTCGTCGTACGCGGAGGCGTTGCGTGAGGTGT CTGCCGCTCGAGAAGAAGTGCCCGGCCGTAGGGGTTTCCCCGGTTACATGTACA CCGATCTGGCCACCATTTACGAGCGCGCCGGTCGTGTGGAGGGCCGCAACGGC TCCATCACGCAGATCCCCATCTTGACTATGCCCAA |
| PC027 | SEQ ID NO: 504 CAAGCTAACTTGAAA GTACTACCAGAAGG SEQ ID NO: 506 GCGTAATACGACTC ACTATAGGCAAGCT AACTTGAAAGTACTA CCAGAAGG | SEQ ID NO: 505 GCGTAATACGACTC ACTATAGGTTTTGGA ATTGAAGGCAATACT CGATCAG SEQ ID NO: 507 TTTTGGAATTGAAGG CAATACTCGATCAG | SEQ ID NO: 503 CAAGCTAACTTGAAAGTACTACCAGAAGGAGCTGAAATCAGAGATGGAGAACGTT TGCCAGTCACAGTAAAGGACATGGGAGCATGCGAGATTTACCCACAAACAATCCA ACACAACCCCATGGGCCGGTTTGTAGTGGTTTTGGTGATGGAGAATACATAATA TACACGGCTATGGCCCTTCGTAACAAAGCATTTGGTAGCGCTCAAGAATTTGTATG GGCACAGGACTCCAGTGAATATGCCATCCGCGAATCCGGATCCACCATTCGAATC TTCAAGAATTTCAAAGAAAAAAGAATTTCAAGTCCGACTTTGGTGCCGAAGGAAT CTATGGTGGTTTTCTCTTGGGTGTGAAATCAGTTTCTGGCTTAGCTTTCTATGACT GGGAAACGCTTGAGTTAGTAAGGCGCATTGAAATACAGCCTAGAGCTATCTACTG GTCAGATAGTGGCAAGTTGGTATGCCTTGCTACCGAAGATAGCTATTTCATATTGT CCTATGACTCTGACCAAGTCCAGAAAGCTAGAGATAACAACCAAGTTGCTGAAGA TGGAGTGGAGGCTGCCTTTGATGTCCTAGGTGAAATAAATGAATCCGTAAGAACA GGTCTTTGGGTAGGAGACTGCTTCATTTACACAAACGCAGTCAACCGTATCAACTA CTTTGTGGGTGGTGAATTGGTAACTATTGCACATCTGGACCGTCCTCTATATGTCC TGGGCTATGTACCTAGAGATGACAGGTTATACTTGGTTGATAAAGAGTTAGGAGTA GTCAGCTATCNAATTGCTATTATCTGTACTCGAATATCAGACTGCAGTCATGCGAC GAGACTTCCCAACGGCTGATCGAGTATTGCCTTCAATTCCAAAA |

TABLE 8-EV

| Target ID | Primers Forward 5' → 3' | Primers Reverse 5' → 3' | dsRNA DNA Sequence (sense strand) 5' → 3' |
|---|---|---|---|
| EV005 | SEQ ID NO: 577 GACAAAACATCCGC AAACTG SEQ ID NO: 579 GCGTAATACGACTC ACTATAGGGACAAA ACATCCGCAAACTG | SEQ ID NO: 578 GCGTAATACGACTC ACTATAGGCTCCTT GCATCAGCTTGATC SEQ ID NO: 580 CTCCTTGCATCAGC TTGATC | SEQ ID NO: 576 GACAAAACATCCGCAAACTGATTAAAGATGGTCTTATTATTAAAAAGCCTGTCGCG GTGCATTCCGTGCACGTGTACGCAAAAATACTGAAGCCCGCAGGAAAGGTCGTC ATTGTGGATTTGGTAAAAGGAAAGGAACTGCAAATGCTAGGATGCCCAGAAAGGA ATTATGGATTCAACGTATGAGAGTTCTCAGAAGGTTATTGAAGAAATATAGGGAAG CTAAGAAAATTGATAGGCATTTATACCATGCTTTATATATGAAAGCTAAGGGAAAT GTATTCAAGAATAAGAGAGTAATGATGGACTATATCCATAAAAAGAAGGCGGAAA AGCACGTACAAAGATGCTCAATGATCAAGCTGATGCAAGGAG |

TABLE 8-EV-continued

| Target ID | Primers Forward 5' → 3' | Primers Reverse 5' → 3' | dsRNA DNA Sequence (sense strand) 5' → 3' |
|---|---|---|---|
| EV009 | SEQ ID NO: 582<br>CAGGACTGAAGAAT<br>CTATAATAGG<br>SEQ ID NO: 584<br>GCGTAATACGACTC<br>ACTATAGGCAGGAC<br>TGAAGAATCTATAAT<br>AGG | SEQ ID NO: 583<br>GCGTAATACGACTC<br>ACTATAGGCTGGAA<br>AGATGGGTAATACTT<br>C<br>SEQ ID NO: 585<br>CTGGAAAGATGGGT<br>AATACTTC | SEQ ID NO: 581<br>CAGGACTGAAGAATCTATAATAGGAACAAACCCAGGAATGGGTTTTAGGCCAATG<br>CCCGACAACAACGAAGAAAGTACCCTGATTTGGTTACAGGGTTCTAATAAAACAAA<br>CTACGAAAAATGGAAAATGAATCTCCTCTCATATTTAGACAAGTATTACACTCCCG<br>GAAAAATAGAAAAGGGAAATATTCCAGTAAAGCGCTGTTCATACGGAGAAAAATTG<br>ATTAGGGGACAAGTATGTGATGTAGATGTGAGGAAATGGGAGCCGTGCACCCCG<br>GAAAATCATTTTGATTACCTCAGAAATGCGCCTTGTATATTTCTGAAGCTGAACAG<br>GATATATGGATGGGAACCGGAGTACTACAACGATCCAAATGATCTTCCAGATGAT<br>ATGCCGCAGCAGTTGAAGGACCATATACGTTATAATATCACCAATCCAGTGGAGA<br>GAAATACCGTCTGGGTAACATGCGCAGGTGAAAATCCGGCAGACGTGGAGTACTT<br>GGGCCCTGTGAAGTATTACCCATCTTTCCAG |
| EV010 | SEQ ID NO: 587<br>CCAATGGAGACTTG<br>AAGATGTC<br>SEQ ID NO: 589<br>GCGTAATACGACTC<br>ACTATAGGCCAATG<br>GAGACTTGAAGATG<br>TC | SEQ ID NO: 588<br>GCGTAATACGACTC<br>ACTATAGGCTTCCCT<br>CATCAACATGTGC<br>SEQ ID NO: 590<br>CTTCCCTCATCAACA<br>TGTGC | SEQ ID NO: 586<br>CCAATGGAGACTTGAAGATGTCCTTCAACGCCATATTAGAAGTGAAGTGTTCTAGA<br>GAACTTAAAGTACAAGGAGGTATAGGTCCTTGTGTCTCTCTAAATGTCAAAAATCC<br>TCTTGTTTCTGATTTAGAAATAGGCATGGGTAACACAGTTCAGTGGAAACTGTGTA<br>GCTTAAGTCCAAGCACTACGGTTGCCTTATTTTTCGAAGTTGTTAATCAGCATGCA<br>GCACCCATTCCTCAAGGGGGACGTGGATGCATTCAGTTTATTACTCAATATCAGC<br>ATTCAAGTGGTCAGAAAAAAATAAGGGTAACTACAATAGCAAGAATTGGGCGGA<br>TGCCACTGCAAATATTCACCATATTAGCGCTGGCTTTGACGAACAAACTGCGGCT<br>GTTTTAATGGCGAGGATCGCTGTATATAGAGCAGAAACTGATGAGAGTTCAGATG<br>TTCTCAGATGGGTTGACAGAATGTTGATACGATTGTGTCAGAAATTTGGAGAATAT<br>AACAAAGATGACACCAACAGCTTCAGGCTCAGTGAAAACTTCAGCTTATATCCACA<br>GTTTATGTATCATCTACGTCGTTCCCAATTTCTACAAGTGTTCAATAATTCACCAGA<br>TGAAACTTCATTCTATAGGCACATGTTGATGAGGGAAG |
| EV015 | SEQ ID NO: 592<br>GTTAAGCCTCCAAG<br>GGGTATTC<br>SEQ ID NO: 594<br>GCGTAATACGACTC<br>ACTATAGGGTTAAG<br>CCTCCAAGGGGTAT<br>TC | SEQ ID NO: 593<br>GCGTAATACGACTC<br>ACTATAGGGAGCAC<br>AAAGAAGCCAAGTC<br>AG<br>SEQ ID NO: 595<br>GAGCACAAAGAAGC<br>CAAGTCAG | SEQ ID NO: 591<br>GTTAAGCCTCCAAGGGGTATTCTCCTTTACGGGCCTCCCGGCACGGGGAAAACG<br>CTGATCGCCAGGGCCGTTGCCAACGAAACTGGTGCGTTCTTCTTCCTCATCAATG<br>GGCCCGAGATTATGAGCAAGCTGGCCGGAGAATCCGAGAGCAATCTTAGAAAGG<br>CTTTTGAAGAGGCTGATAAAAACTCTCCTGCAATCATCTTTATCGACGAATTAGAC<br>GCAATCGCTCCCAAGCGCGAGAAGACTCATGGTGAGGTAGAGAGACGCATCGTC<br>TCCCAACTGTTGACTTTGATGGACGGCATGAAGAAAAGTTCCCATGTGATCGTGA<br>TGGCGGCCACGAACAGGCCCAATTCCATCGACCCTGCACTCAGACGTTTCGGCC<br>GATTCGACAGAGAGATCGACATCGGTATCCCCGACGCTACTGGAAGATTAGAAGT<br>ACTCAGAATACACACCAAAAACATGAAATTGGCTGACGATGTAGATTTGGAACAGA<br>TTGCCGCAGAGACTCACGGTCATGTAGGTGCTGACTTGGCTTCTTTGTGCTC |
| EV016 | SEQ ID NO: 597<br>GGTGATCCTTGATA<br>GTGTTAAG<br>SEQ ID NO: 599<br>GCGTAATACGACTC<br>ACTATAGGGGTGAT<br>CCTTGATAGTGTTAA<br>G | SEQ ID NO: 598<br>GCGTAATACGACTC<br>ACTATAGGCCTCAG<br>CATAAGATGACATG<br>SEQ ID NO: 600<br>CCTCAGCATAAGAT<br>GACATG | SEQ ID NO: 596<br>GGTGATCCTTGATAGTGTTAAGTTTCCAAAATTTAACGAAATTGTACAGCTCAAGTT<br>ATCAGATGGAACAGTTAGGTCTGGACAAGTTTTGGAAGTCAGTGGACAGAAGGCG<br>GTTGTCCAAGTTTTTGAAGGCACCTCCAGATTGATGCTAAAAACACTTTTATGTGA<br>ATTTACAGGAGATATCTTAAGCACTCCAGTGTCTGAAGATATGTTGGGTCGTGTGT<br>TTAATGGATCTGGAAAGCCTATCGATAAAGGGCCGCCAATCTTAGCTGAAGATTTT<br>CTTGACATTCAAGGTCAACCTATAAATCCTTGGTCTCGTATCTATCCAGAAGAAAT<br>GATCCAGACTGGTATTTCTGCGATTGATGTGATGAATTCCATTGCCAGAGGACAAA<br>AGATTCCAATTTTCTCTGCAGCTGGTTTACCCCACAATGAAATCGCTGCTCAAATC<br>TGTAGACAAGCTGCTTGTCAAAATCCCAGGGGAAATCTGTCTTAGATGATCATGA<br>AGACAACTTTGCTATCGTTTTCGCCGCTATGGGTGTCAATATGGAAACAGCCAGAT<br>TCTTCAAGCAAGATTTTGAAGAGAATGGCTCTATGGAAATGTGTGCCTATTTTTG<br>AACTTGGCCAATGATCCTACCATTGAAAGAATTATAACACCCCGTTTGACTTTAAC<br>AGCGGCTGAATTTATGGCATATCAATGTGAGAAGCATGTGTTAGTCATATTGACTG<br>ACATGTCATCTTATGCTGAGG |

TABLE 8-AG

| Target ID | Primers Forward 5' → 3' | Primers Reverse 5' → 3' | dsRNA DNA Sequence (sense strand) 5' → 3' |
|---|---|---|---|
| AG001 | SEQ ID NO: 769<br>GCGTAATACGACTC<br>ACTATAGGGCATGG<br>ATGTTGGACAAATTG<br>G<br>SEQ ID NO: 771<br>GCATGGATGTTGGA<br>CAAATTGG | SEQ ID NO: 770<br>GATTTCCAGTTGGAT<br>GGTGTCG<br>SEQ ID NO: 772<br>GCGTAATACGACTC<br>ACTATAGGGATTTCC<br>AGTTGGATGGTGTC<br>G | SEQ ID NO: 768<br>GCATGGATGTTGGACAAATTGGGGGGTGTGTTCGCCCCCAGGCCCTCCACCGGG<br>CCACACAAGCTCAGGGAGTCCCTTCCATTAGTGATTTTCTTGCGTAACAGGTTGAA<br>GTACGCCCTGACAAACTGTGAGGTGACCAAGATCGTTATGCAGAGACTTATTAAG<br>GTCGACGGCAAAGTCAAGTGATCCTAACTATCCTGCTGGATTCATGGATGTGA<br>TCACCATTGAAAAAACTGGTGAATTCTTCCGTTTGATCTATGATGTTAAGGGAAGA<br>TTCACTATTCACAGGATCACTGCTGAAGAAGCAAAATACAAATTGTGCAAAGTCCG<br>CAAGGTGCAAACCGGACCAAAAGGTATTCCATTCTTGGTCACCCACGATGGTAGG<br>ACCATTAGGTACCCTGACCCAATGATCAAGGTAAACGACACCATCCAACTGGAAA<br>TC |
| AG005 | SEQ ID NO: 774<br>GCGTAATACGACTC<br>ACTATAGGCAACAC | SEQ ID NO: 775<br>CCTTTTGCCTTCTGG<br>CGTTAG | SEQ ID NO: 773<br>CAACACCAACTCGAGGCAAACATCCGTAAATTGATCAAGGATGGTTTGATCATTA<br>AGAAACCGGTGGCAGTGCACTCTAGGGCTCGTGTCCGTAAAAACACAGAAGCTC |

TABLE 8-AG-continued

| Target ID | Primers Forward 5' → 3' | Primers Reverse 5' → 3' | dsRNA DNA Sequence (sense strand) 5' → 3' |
|---|---|---|---|
| | CAACTCGAGGCAAAAC SEQ ID NO: 776 CAACACCAACTCGAGGCAAAAC | SEQ ID NO: 777 GCGTAATACGACTCACTATAGGCCTTTTGCCTTCTGGCGTTAG | GCAGGAAGGGAAGGCACTGCGGTTTCGGTAAGAGGAAAGGTACAGCGAACGCTCGTATGCCTCAAAAGGAACTATGGATCCAAAGGATGCGTGTCTTGAGGCGTCTCCTGAAAAAATACAGGGAAGCCAAAAAGATCGACAGGCATCTGTACCACGCCCTGTACATGAAGGCCAAGGGTAACGTGTTCAAGAACAAGAGAGTGTTGATGGAATACATCCACAAGAAGAAGGCTGAGAAGGCCCGTGCCAAGATGTTGGCCGACCAAGCTAACGCCAGAAGGCAAAAGG |
| AG010 | SEQ ID NO: 779 GCGTAATACGACTCACTATAGGCAAACTTTCCAAAGGGTGTTCG SEQ ID NO: 781 CAAACTTTCCAAAGGGTGTTCG | SEQ ID NO: 780 GAAGGATGCCTGGTCATCTTTG SEQ ID NO: 782 GCGTAATACGACTCACTATAGGGAAGGATGCCTGGTCATCTTTG | SEQ ID NO: 778 CAAACTTTCCAAAGGGTGTTCGCGAAGGACCAGAATGGACATTTGAAGATGGCTTTCAACGGTACTTTGGAGGTGAAGTGCTCTAGGGAATTAAAAGTTCAAGGCGGTATTGGCTCATGCGTGTCGCTAAATGTAAAAAGTCCTTTGGTAGCGGACACGGAAATAGGCATGGGAAACACCGTGCAATGGAAGATGTGCACCTTCAACCCTAGCACGACGATGGCGCTGTTTTTCGAGGTGGTCAATCAGCATTCGGCCCCCATTCCTCAAGGTGGTAGAGGATGTATACAGTTTATTACACAATATCAGCACTCGAGTGGCCAAAGGAGGATAAGGGTGACGACGATAGCGAGAAATTGGGCGACGCATCGGCGAATATTCACCACATCAGCGCGGGTTTCGATCAGGAACGTGCCGCGGTGATTATGGCCCGGATGGCTGTTTATAGAGCGGAGACCGATGAGAGTCCCGATGTTTAAGATGGGTCGATCGGATGCTGATTCGTTTGTGTCAAAAGTTTGGAGAATATAACAAAGATGACCAGGCATCCTTC |
| AG014 | SEQ ID NO: 784 GCGTAATACGACTCACTATAGGGAAAAGGCCGAGGAAATTGATG SEQ ID NO: 786 GAAAAGGCCGAGGAAATTGATG | SEQ ID NO: 785 CAACTGTTGCGAAATCAGGTCC SEQ ID NO: 787 GCGTAATACGACTCACTATAGGCAACTGTTGCGAAATCAGGTCC | SEQ ID NO: 783 GAAAAGGCCGAGGAAATTGATGCCAAGGCGGAAGAAGAATTTAACATTGAAAAGGGCCGCCTTGTGCAACAACAAAGATTGAAGATCATGGAATACTATGAGAAGAAGGAGAAGCAAGTCGAACTACAAAAGAAAATTCAATCCTCCAACATGCTGAACCAAGCCCGTCTTAAGGTTCTGAAAGTCCGCGAAGATCATGTTAGAGCTGTATTGGATGAGGCTCGCAAGAAGCTTGGTGAAGTCACCAGGGATCAAGGCAAATATGCCCAGATTCTGGAATCTTTGATCCTTCAGGGACTCTACCAGCTTTTCGAGGCAAACGTGACCGTACGCGTCCGCCCACAAGACAGAACCTTAGTCCAATCAGTGCTGCCAACCATCGCAACCAAATACCGTGACGTCACCGGCCGAGATGTACACCTGTCCATCGATGACGAAACTCAACTGTCCGAATCCGTAACCGGCGGAATCGAACTTTTGTGCAAACAAACAAAATTAAGGTCTGCAACACCCTGGAGGCACGTTTGGGACCTGATTTCGCAACAGTTG |
| AG016 | SEQ ID NO: 789 GCGTAATACGACTCACTATAGGGTGTTCAACGGATCAGGAAAACC SEQ ID NO: 791 GTGTTCAACGGATCAGGAAAACC | SEQ ID NO: 790 CGACCGGCTCTTTCGTAAATG SEQ ID NO: 792 GCGTAATACGACTCACTATAGGCGACCGGCTCTTTCGTAAATG | SEQ ID NO: 788 GTGTTCAACGGATCAGGAAAACCCATTGACAAAGGTCCTCCAATCTTAGCCGAAGATTTCTCAAGGTCAACCATCAACCCATGGTCGCGTATCTACCCGGAAGAAATGATCCAGACCGGTATCTCCGCCATCGACGTGATGAACTCCATCGCGCGTGGGCAAAAATCCCCATTTTCTCCGCGGCCGGTTTACCGCACAACGAAATCGCCGCCCAAATCTGTAGACAGGCCGGTTTAGTCAAACTGCCGGGCAAATCGGTAATCGACGATCACGAGGACAATTTCGCCATCGTGTTCGCCGCCATGGGTGTCAACATGGAAACCGCCCGTTTCTTCAAGCAGGACTTCGAAGAAAACGGTTCCATGGAAGACGTGTGTCTCCTTCTTGAATTTGGCCAACGATCCCACCATCGAGAGAATCATCACGCCCCGTTTGGCTCTGACCGCCGCCGAATTTTTGGCTTATCAATGCGAGAAACACGTGCTGGTTATCTTAACTGATATGTCTTCTTACGCCGAGGCTTTGCGTGAAGTATCCGCCGCCAGAGAAGAAGTACCCGGACGTCGTGGGTTCCCCGGTTACATGTACACCGATTTGGCCACCATTTACGAAAGAGCCGGTCG |

TABLE 8-TC

| Target ID | Primers Forward 5' → 3' | Primers Reverse 5' → 3' | dsRNA DNA Sequence (sense strand) 5' → 3' |
|---|---|---|---|
| TC001 | SEQ ID NO: 864 GCGTAATACGACTCACTATAGGCTGCGAAACAGGCTGAAGTATGC SEQ ID NO: 866 CTGCGAAACAGGCTGAAGTATGC | SEQ ID NO: 865 GGTGTGCCCATTTGCATCCT SEQ ID NO: 867 GCGTAATACGACTCACTATAGGGGTGTGCCCATTTGCATCCT | SEQ ID NO: 863 CTGCGAAACAGGCTGAAGTATGCCTTGACCAACTCAGAAGTGACGAAGATTGTTATGCAAAGATTGATTAAAGTTGACGGAAAAGTTAGGACAGACCCCAACTACCCCGCGGGTTTCATGGATGTTGTGACTATTGAGAAAACTGGGGAATTCTTCCGCTTGATTTATGATGTTAAGGGAAGGTTCACAATCCATCGCATTACTGGAGAAGAGGCCAAATATAAATTGTGCAAAGTGAAGAAAGTACAGACAGGCCCCAAGGGCATTCCCTTCTTGGTGACCCGCGACGACGCACTATCAGATACCCAGACCCCATGATCAAAGTGAATGACACCATTCAATTGGAGATTGCCACTTCGAAAATTCTTGATTTTATCAAATTTGAGTCCGGTAATTTGTGTATGATTACTGGAGGTCGTAACTTGGGCGTGTCGGTACAGTGGTGAGCCGAGAACGTCACCCAGGTTCCTTCGACATCGTTCATATTAAGGATGCAAATGGGCACACC |
| TC002 | SEQ ID NO: 869 GCGTAATACGACTCACTATAGGCATCCATGTTGAGGTGGGCA SEQ ID NO: 871 CATCCATGTTGAGGTGGGCA | SEQ ID NO: 870 CTTTGTGAACAGCGGCCATC SEQ ID NO: 872 GCGTAATACGACTCACTATAGGCTTTGTGAACAGCGGCCATC | SEQ ID NO: 868 CATCCATGTTGAGGTGGGCATTTTTGAGGGCGTCCGCTGCGTTTTTCATCGTTTTGAGTACGGCTGTGTTGGTGTTGGCCCCCTCGAGGGCCTCCCGCTGCATCTCGATGGTGCTGAGGGTGCCATCGATCTGCTGAGCTGCTTTTTCGTAGCGTTTCTTCCTCTTGATGGCCTGGATGGCCGCTGTTCACAAAG |
| TC010 | SEQ ID NO: 874 GCGTAATACGACTCACTATAGGATGTAC | SEQ ID NO: 875 ATGTCCTGGTACTTGAGGTTCCTCC | SEQ ID NO: 873 ATGTCCTGGTACTTGAGGTTCCTCCATTGGGCGATTGTCTCACCGTGGAAAATCAAAATTTGGAAAAATGTGTCCATGAGAAGGATCCGATCGGGTTGAATGGAACTAGT |

TABLE 8-TC-continued

| Target ID | Primers Forward 5' → 3' | Primers Reverse 5' → 3' | dsRNA DNA Sequence (sense strand) 5' → 3' |
|---|---|---|---|
| | CATTTGCGCCGCTC SEQ ID NO: 876 ATGTACCATTTGCG CCGCTC | SEQ ID NO: 877 GCGTAATACGACTC ACTATAGGATGTCCT GGTACTTGAGGTTC CTCC | GTCGAGGAGGACGGGTTCAGGGGGGCCGTTGAAACTATAACTGTACAAAATCGG CTGGATCATAATGAGACTTTGGGTGAGGTCCTCCCGCATCAGCATGTGGCGGTAG AACGAGGTCTCGTCTGGGGAGTTGTTGAAAACTTGGAGGAATTGGGAGCGGCGC AAATGGTACAT |
| TC014 | SEQ ID NO: 879 GCGTAATACGACTC ACTATAGGCAACAG CGCTTGAAGATCAT GG SEQ ID NO: 881 CAACAGCGCTTGAA GATCATGG | SEQ ID NO: 880 ACAAGGCCGTACGA ATTTCTGG SEQ ID NO: 882 GCGTAATACGACTC ACTATAGGACAAGG CCGTACGAATTTCT GG | SEQ ID NO: 878 CAACAGCGCTTGAAGATCATGGAATATTACGAGAAGAAGGAGAAACCGGTGGAAT TGCAGAAGAAATTCAGTCGTCAAACATGCTGAACCAAGCCCGTTTGAAAGTATTA AAAGTGCGTGAAGACCACGTCCACAATGTGCTGGATGACGCCCGCAAACGTCTG GGCGAAATCACCAATGACCAGGCGAGATATTCACAACTTTTGGAGTCTCTTATCCT CCAGAGTCTCTACCAGTACTTGGGAATCAGTGATGAGTTGTTTGAGAACAATATAG TGGTGAGAGTCAGGCAACAGGACAGGAGTATAATCAGGGCATTCTCCCAGTTGT TGCGACGAAATACAGGGACGCCACTGGTAAAGACGTTCATCTTAAAATCGACGAT GAGAGCCACTTGCCTCATCCGAAACCACCGGAGGAGTGGTTTTGTATGCGCAAAAG GGTAAATCAAGATTGACAACACCTTGGAGGCTCGTTTGGATTTAATTGCACAGCA ACTTGTGCCAGAAATTCGTACGGCCTTGT |
| TC015 | SEQ ID NO: 884 GCGTAATACGACTC ACTATAGGCGATAC AGTGTTGCTGAAAG GGAAG SEQ ID NO: 886 CGATACAGTGTTGC TGAAAGGGAAG | SEQ ID NO: 885 TCGGATTCGCCGGC TAATTTAC SEQ ID NO: 887 GCGTAATACGACTC ACTATAGGTCGGAT TCGCCGGCTAATTT AC | SEQ ID NO: 883 CGATACAGTGTTGCTGAAAGGGAAGCGGCGGAAAGAGACCGTCTGCATTGTGCT GGCCGACGAAAACTGCCCCGATGAGAAGATCCGGATGAACAGGATCGTCAGGAA TAATCGGTTTAGGCTCTCTGACGTCGTCTGGATCCAGCCCTGTCCCGACGTC AAATACGGGAAGAGGATCCACGTTTTGCCCATCGATGACACGGTCGAAGGGCTC GTCGGAAATCTCTTCGAGGTGTACTTAAAACCATACTTCCTGAAGCTTATCGACC AATCCACAAAGGCGACGTTTTCATCGTCCGTGGTGGCATGCGAGCCGTTGAATTC AAAGTGGTGGAAACGGAACCGTCACCATATTGTATCGTCGCCCCCGATACCGTCA TCCATTGTGACGGCGATCCGATCAAACGAGAAGAAGAGGAGGAAGCCTTGAACG CCGTCGGCTACGACGATATCGGCGGTTGTCGCAAACAACTCGCACAAATCAAGA AATGGTCGAATTACCTCTACGCACCCGTCGCTCTTCAAGGCCATTGGCGTGAAA CCACCACGTGGTATCCTCTTGTACGGACCTCCAGGTACCGGTAAAACTTTAATCG CACGTGCAGTGGCCAACGAAACCGGTGCTTTCTTCTTCTTAATCAACGGTCCCGA AATTATGAGTAAATTAGCCGGCGAATCCGA |

TABLE 8-MP

| Target ID | Primers Forward 5' → 3' | Primers Reverse 5' → 3' | dsRNA DNA Sequence (sense strand) 5' → 3' |
|---|---|---|---|
| MP001 | SEQ ID NO: 1042 GCGTAATACGACTC ACTATAGGGTTTAAA CGCACCCAAAGCAT GG SEQ ID NO: 1044 GTTTAAACGCACCC AAAGCATGG | SEQ ID NO: 1043 CAATACCAACACGC CCTAAATTGC SEQ ID NO: 1045 GCGTAATACGACTC ACTATAGGCAATAC CAACACGCCCTAAA TTGC | SEQ ID NO: 1041 GTTTAAACGCACCCAAAGCATGGATGTTGGACAAATCGGGGGTGTCTTCGCTCC ACGTCCAAGCACCGGTCCACACAAACTTCGTGAATCACTACCGTTATTGATCTTCT TGCGTAATCGTTTGAAGTATGCACTTACTGGTGCCGAAGTCACCAAGATTGTCATG CAAAGATTAATCAAGGTTGATGGCAAAGTCCGTACCGACCCGTAATTATCCAGCCG GTTTTATGGATGTTATATCTATCCAAAAGACCAGTGAGCACTTTAGATTGATCTATG ATGTGAAAGGTCGTTTCACCATCCACAGAATTACTCCTGAAGAAGCAAAATACAAG TTGTGTAAAGTAAAGAGGGTACAAACTGGACCCAAAGGTGTGCCATTTTTAACTAC TCATGATGGCCGTACTATTCGCTACCCTGACCCTAACATCAAGGTTAATGACACTA TTAGATACGATATTGCATCATCTAAAATTTTGGATCATATCCGTTTTGAAACTGGAA ACTTGTGCATGATAACTGGAGGTCGCAATTTAGGGCGTGTTGGTATTG |
| MP002 | SEQ ID NO: 1047 GCGTAATACGACTC ACTATAGGGGTGGC AAAAAGGAAGAGAA GG SEQ ID NO: 1049 GGTGGCAAAAAGGA AGAGAAGG | SEQ ID NO: 1048 GCTGATTTAAGTGC ATCTGCTGC SEQ ID NO: 1050 GCGTAATACGACTC ACTATAGGGCTGAT TTAAGTGCATCTGCT GC | SEQ ID NO: 1046 GGTGGCAAAAAGGAAGAAGGGACCATCAACCGAAGATGCGATACAAAGCTT CGATCCACTGAAGAGATGCTGATAAAGAAACAAGAATTTTTAGAAAAAAAATTGA ACAAGAAGTAGCGATAGCCAAAAAAATGGTACAACTAATAAACGAGCTGCATTG CAAGCATTGAAGCGTAAGAAACGGTACGAACAACAATTAGCCCAAATTGATGGTA CCATGTTAACTATTGAACAACAGCGGGAGGCATTAGAAGGTGCCAACACAAATAC AGCAGTATTGACTACCATGAAAACTGCAGCAGATGCACTTAAATCAGC |
| MP010 | SEQ ID NO: 1052 GCGTAATACGACTC ACTATAGGCAGACC CTGTTCAGAATATG SEQ ID NO: 1054 CAGACCCTGTTCAG AATATG | SEQ ID NO: 1053 GCATTGGGAATCGA GTTTTGAG SEQ ID NO: 1055 GCGTAATACGACTC ACTATAGGGCATTG GGAATCGAGTTTTG AG | SEQ ID NO: 1051 CAGACCCTGTTCAGAATATGATGCATGTTAGTGCTGCATTTGATCAAGAAGCATCT GCCGTTTAATGCTCGTATGGTAGTGAACCGTGCTGAAACTGAGGATAGTCCAG ATGTGATGCGTTGGGCTGATCGTACGCTTATACGCTTGTGTCAAAAATTTGGTGAT TATCAAAAAGATGATCCAAATAGTTTCCGATTGCCAGAAACTTCAGTTTATATCCA CAGTTCATGTATCATTTAAGAAGGTCTCAATTTCTACAAGTTTTTAATAATAGTCCT GATGAAACATCATATTATAGGCACATGTTGATGCGTAAAGATGTTACCCAAAGTCT AATCATGATACAGCCAATTCTGTATAGCTATATAGTTTTAATGGTAGGCCAGAACCTG TACTTTTGGATACCAGTAGTATTCAACCTGATAAAATATTATTGATGACACATTTTT TCCATATTTTGATATTCCATGGAGAGACTATTGCTCAATGGAGAGCAATGGATTAT CAAAATAGACCAGAGTATAGTAACCTCAAGCAGTTGCTTCAAGCCCCCGTTGATG ATGCTCAGGAAATTCTCAAAACTCGATTCCCAATGC |

TABLE 8-MP-continued

| Target ID | Primers Forward 5' → 3' | Primers Reverse 5' → 3' | dsRNA DNA Sequence (sense strand) 5' → 3' |
|---|---|---|---|
| MP016 | SEQ ID NO: 1057 GCGTAATACGACTCACTATAGGGTTTTCAATGGCAGTGGAAAGC<br>SEQ ID NO: 1059 GTTTTCAATGGCAGTGGAAAGC | SEQ ID NO: 1058 CGTGGTGTAATGATACGCTC<br>SEQ ID NO: 1060 GCGTAATACGACTCACTATAGGCGTGGTGTAATGATACGCTC | SEQ ID NO: 1056 GTTTTCAATGGCAGTGGAAAGCCGATAGATAAAGGACCTCCTATTTTGGCTGAAGATTATTTGGATATTGAAGGCCAACCTATTAATCCATACTCCAGAACATATCCTCAAGAAATGATTCAAACTGGTATTTCAGCTATTGATATCATGAACTCTATTGCTCGTGGACAAAAAATTCCAATATTTTCAGCTGCAGGTTTACCACATAATGAGATTGCTGCTCAAATTTGTAGACAAGCTGGTCTCGTTAAAAAACCTGGTAAATCAGTTCTTGACGATCATGAAGACAATTTTGCTATAGTATTTGCTGCTATGGGTGTTAATATGGAAACAGCCAGATTCTTTAAACAAGATTTTGAGGAAAATGGTTCAATGGAGAATGTTTGTTTGTTCTTGAATTTAGCTAATGATCCTACTATTGAGCGTATCATTACACCACG |
| MP027 | SEQ ID NO: 1062 GCGTAATACGACTCACTATAGGGCTCGTTTGTTTCCATCCAGAAC<br>SEQ ID NO: 1064 GCTCGTTTGTTTCCATCCAGAAC | SEQ ID NO: 1063 CCAAAAATACCATCTGCTCCACC<br>SEQ ID NO: 1065 GCGTAATACGACTCACTATAGGCCAAAAATACCATCTGCTCCACC | SEQ ID NO: 1061 GCTCGTTTGTTTCCATCCAGAACTTCCCATCGTGTTAACTGGCTCAGAAGATGGTACCGTCAGAATTTGGCATTCTGGTACTTATCGATTAGAATCATCATTAAACTATGGGTTAGAACGTCGTATCGACAATCTGTTCGTTACGGGGATGTTAATAATGTAGCTCTAGGTTATGATGAAGGAAGTATAATGGTTAAAGTTGGTCGTGAAGAGCCAGCAATGTCAATGGATGTTCATGGGGGTAAAATTGTTTGGGCACGTCATAGTGAAATTCAACAAGCTAACCTTAAAGCGATGCTTCAAGCAGAAGGAGCCGAAATCAAAGATGGTGAACGTTTACCAATACAAGTTAAAGACATGGGTAGCTGTGAAATTTATCCACAGTCAATATCTCATAATCCGAATGGTAGATTTTTAGTAGTATGTGGTGATGGAGAGTATATTATATATACATCAATGGCTTTGCGTAATAAAGCATTTGGCTCCGCTCAGGATTTTGTATGGTCTTCTGATTCTGAGTATGCCATTAGAGAAATTCTTCTACAATCAAAGTTTTTTAAAATTTTAAAGAAAAAAAGTCTTTTAAACCAGAAGGTGGAGCAGATGGTATTTTGG |

TABLE 8-NL

| Target ID | Primers Forward 5' → 3' | Primers Reverse 5' → 3' | dsRNA DNA Sequence 5' → 3' |
|---|---|---|---|
| NL001 | SEQ ID NO: 1573 GCGTAATACGACTCACTATAGGGAAATCATGGATGTTGGACAAATTGG<br>SEQ ID NO: 1575 GAAATCATGGATGTTGGACAAATTGG | SEQ ID NO: 1574 ACTGAGCTTCACACCCTTGCCC<br>SEQ ID NO: 1576 GCGTAATACGACTCACTATAGGACTGAGCTTCACACCCTTGCCC | SEQ ID NO: 1572 GAAATCATGGATGTTGGACAAATTGGGTGGTGTGTATGCACCCCGACCCAGCACAGGTCCACACAAGCTGCGAGAATCTCTCCCACTTGTCATATTTTTGCGTAATCGGCTCAAGTACGCTTTAACTAACTGTGAAGTGAAGAAAATTGTGATGCAGCGTCTCATCAAGGTTGACGGCAAAGTGAGGACTGACCCCAACTATCCTGCAGGTTTTATGGACGTTGTTCAAATCGAAAAGACAAACGAGTTCTTCCGTTTGATCTATGATGTTAAGGGACGTTTCACCATCCACAGGATCACAGCTGAAGAAGCTAAGTACAAGCTGTGCAAAGTGAAGAGGGTTCAGACAGGACCCAAGGGCATTCCATTTTTGACCACTCACGATGGACGCACCATCCAGGTATCCAGACCCCTTAGTAAAAGTCAATGACACCATCCAATTGGACATTGCCACATCCAAAATCATGGACTTCATCAGATTCGACTCTGGTAACCTGTGTATGATCACTGGAGGTCGTAACTTGGGTCGTGTGGGCACTGTCGTGAACAGGGAGCGACACCCGGGGTCTTTCGACATCGTGCACATCAAGGACGTGTTGGGACACACTTTTGCCACTAGGTTGAACAACGTTTTCATCATCGGCAAGGGTAGTAAAGCATACGTGTCTCTGCCCAAGGGCAAGGGTGTGAAGCTCAGT |
| NL002 | SEQ ID NO: 1578 GCGTAATACGACTCACTATAGGGATGAAAAGGGCCCTACAACTGGC<br>SEQ ID NO: 1580 GATGAAAAGGGCCCTACAACTGGC | SEQ ID NO: 1579 CTGATCCACATCCATGTGTTGATGAG<br>SEQ ID NO: 1581 GCGTAATACGACTCACTATAGGCTGATCCACATCCATGTGTTGATGAG | SEQ ID NO: 1577 GATGAAAAGGGCCCTACAACTGGCGAAGCCATTCAGAAACTACGCGAAACAGAGGAAATGTGATAAAGAACAAGACTTTTTAGAAAAGAAAATTGAAGTTGAAATTGGAGTTGCCAGGAAGAATGGAACAAAAACAAAAGAGCCGCATCCAGGCACTCAAAAGGAAGAAGAGGTATGAAAAGCAATTGCAGCAGATCGATGGAACGTTATCAACAATTGAGATGCAGAGAGGCCCTCGAAGGAGCCAACACGAATACGGCCGTACTGCAAACTATGAAGAACGCAGCAGATGCTCTCAAAGCGGCTCATCAACACATGGATGTGGATCAG |
| NL003 | SEQ ID NO: 1583 GCGTAATACGACTCACTATAGGTCCGCGTCGTCCTTACGAGAAGGC<br>SEQ ID NO: 1585 TCCGCGTCGTCCTTACGAGAAGGC | SEQ ID NO: 1584 TTGACGCGACCAGGTCGGCCAC<br>SEQ ID NO: 1586 GCGTAATACGACTCACTATAGGTTGACGCGACCAGGTCGGCCAC | SEQ ID NO: 1582 TCCGCGTCGTCCTTACGAGAAGGCACGTCTCGAACAGGAGTTGAAGATCATCGGAGAGTATGGACTCCGTAACAAGCGTGAGGTGTGGAGAGTCAAATACGCCCTGGCCAAGATTCGTAAGGCCGCTCGTGAGCTGTTGACTCTGGAAGAGAAGGACCAGAAACGTTTGTTTGAAGGTAACGCCCTGCTGCGTCGCCTGGTGCGTATTGGAGTGTTGGACGAAGGAAGAATGAAGCTCGATTACGTCTTGGGTTTAAAATTGAAGATTTCCTTGAACGTCGTCTACAGACTCAGGTGTACAAACTCGGTTTGGCCAAGTCCATCCATCACGCCCGTGTACTCATCAGACAAGACATATCAGAGTGCGCAAACAAGTAGTGAACATTCCGAGCTTTGTGGTGCGCCTGGACTCGCAGAAGCACATTGACTTCTCGCTGAAGTCGCCGTTCGGCGGTGGCCGACCTGGTCGCGTCAA |
| NL004 | SEQ ID NO: 1588 GCGTAATACGACTCACTATAGGGGAGTTGGCTGCTGTAAGAACTG<br>SEQ ID NO: 1590 GGAGTTGGCTGCTGTAAGAACTG | SEQ ID NO: 1589 CTGTTGTTGACTGTTGGATGAGG<br>SEQ ID NO: 1591 GCGTAATACGACTCACTATAGGCTGTTGTTGACTGTTGGATGAGG | SEQ ID NO: 1587 GGAGTTGGCTGCTGTAAGAACTGTCTGCTCTCACATCGAAAACATGCTGAAGGAGTCACAAGGGATTCCTGTACAAGATGCGTGCCGTGTACGCCCCATTTCCCCATCAACTGCTGACCGAGAACAACTCTGTGATCGAGGTGCTGTAACTTCCTGGGCGAGAAGTACATCCGACGGGTGAGGATGGCGCCCGGCGTCACTGTTACCAACTCGACAAAGCAGAAGGACGAGTCATCGTCGAAGGAAACAGCATAGAGGACGTGTCAAGATCAGCTGCCCTCATCCAACAGTCAACAACAG |

TABLE 8-NL-continued

| Target ID | Primers Forward 5' → 3' | Primers 5' → 3' | Reverse dsRNA DNA Sequence 5' → 3' |
|---|---|---|---|
| NL005 | SEQ ID NO: 1593 GCGTAATACGACTCACTATAGGCGCAAACACAAATTCACGTCAAAGC SEQ ID NO: 1595 CGCAAACACAAATTCACGTCAAAGC | SEQ ID NO: 1594 CCTTCGCTTCTTGGCCTCCTTGAC SEQ ID NO: 1596 GCGTAATACGACTCACTATAGGCCTTCGCTTCTTGGCCTCCTTGAC | SEQ ID NO: 1592 CGCAAACACAAATTCACGTCAAAGCATCAGGAAGCTGATCAAAGACGGTCTTATCATCAAGAAACCGGTTGCAGTACATTCACGTGCTCGCGTTCGTAAAAACACTGAAGCCAGGAGGAAAGGCAGACATTGTGGCTTTGGTAAGAGGAAAGGTACAGCCAACGCCCGTATGCCACAAAAGGTTCTATGGGTGAATCGTATGCGTGTCTTGAGAAGACTGTTGAAAAATACAGACAAGATAAGAAAATCGACAGGCATCTGTACCATCACCTTTACATGAAGGCTAAGGGTAACGTATTCAAGAACAAGCGTGTATTGATGGAGTTCATTCATAAGAAGAAGGCCGAGAAAGCAAGAATGAAGATGTTGAACGACCAGGCTGAAGCTCGCAGACAAAAGGTCAAGGAGGCCAAGAAGCGAAGG |
| NL006 | SEQ ID NO: 1598 GCGTAATACGACTCACTATAGGGTGCTTGTGTCAAGTGGTGTGG SEQ ID NO: 1600 GTGCTTGTGTCAAGTGGTGTGG | SEQ ID NO: 1599 CGAGATGGGATAGCGTGAGG SEQ ID NO: 1601 GCGTAATACGACTCACTATAGGCGAGATGGGATAGCGTGAGG | SEQ ID NO: 1597 GTGCTTGTGTCAAGTGGTGTGGTGGAGTACATTGACACCCTGGAGGAGGAGACGACCATGATAGCGATGTCGCCGGATGACCTGCGTCAGGACAAGGAGTATGCCTACTGTGCCACCTACACGCACTGCGAGATCCACCCGGCCATGATACTCGGTGTGTGCGCCTCTATTATTCCCTTCCCCGATCACAACCAAAGTCCCAGGAACACCTATCAGAGCGCTATGGGGAAACAGGCGATGGGCGTGTACATCACCAACTTCCACGTGCGAATGGACACGCTGGCTCACGTGCTGTTCTACCCGCACAAGCCACTGGTCACCACTCGCTCCATGGGAGTACCTGCGCTTCAGGGAGCTTCCTGCCGGCATCAACTCTGTGGTCGCCATCGCCTGCTACACTGGATACAACCAGGAGGACAGTGTCATTCTCAACGCCTCCGCTGTCGAGCGCGATTCTTCAGATCGGTTTTCTTCCGATCTTACAAAGATGCAGAATCGAAGCGTATTGGCGACCAAGAGGAGCAATTCGAGAAGCCCACCAGACAGACGTGTCAGGGAATGAGGAATGCCATTTATGACAAATTGGACGATGATGCATCATTGCTCCCGGTCTGAGAGTGTCTGGTGACGATGTGGTTATTGGCAAAACCATAACACTGCCCGATAATGATGACGAGCTGGAAGGTACAACAAAGAGGTTCACGAAGAGAGATGCCAGTACTTTCCTGCGTAACAGTGAGACGGGAATCGTCGACCAAGTCATGTTAACCTTGAACTCTGAGGGTTACAAGTTCTGCAAAATTCGAGTCAGGTCTGTGCGTATCCCGCAGATTGGCGATAAGTTCGCTTCCCGACATGGCCAAAAAGGAACGTGTGGAATACAGTATCGTCAAGAGGACATGCCTTTTACAAGCGAGGGAATCGCACCGGATATTATTATCAATCCTCACGCTATCCCATCTCG |
| NL007 | SEQ ID NO: 1603 GCGTAATACGACTCACTATAGGTGAGAGCAATCCTTGACTGTGG SEQ ID NO: 1605 TGAGAGCAATCCTTGACTGTGG | SEQ ID NO: 1604 CCACGGTGAATAGCCACTGC SEQ ID NO: 1606 GCGTAATACGACTCACTATAGGCCACGGTGAATAGCCACTGC | SEQ ID NO: 1602 TGAGAGCAATCCTTGACTGTGGTTTTGAACATCCATCTGAAGTACAACATGAATGCATTCCTCAAGCTGTACTTGGAATGGACATATTGTGTCAAGCGAAATCCGGTATGGGAAAAACTGCTGTATTTGTGTTGGCGACATTACAGCAAATTGAACCAACTGACAACCAAGTCGTGTATTTGGTCATGTCATCAGAGGACGCTTGCATTCCAAATCAGCAAAGAGTATGAACGATTTTCGAAATGTATGCCAAATATCAAGGTTGGAGTTTTCTTCGGCGGACTGCCGATTCAGAGGGATGAGGAGACGTTGAAATTGAACTGTCCTCACATCGTGGTTGGAACACCCGGACGAATTTTGGCGTTGGTACGCAACAAGAAGCTGGACCTCAAGCATCTCAAGGACACTTTGTCCTTGACGAATGTGACAAAATGTTGGAACTGTTAGATATGCGAAGAGATGTGCAGGAAATATTCCGAAACACGCCGCACAGCAAACAAGTCATGATGTTCAGTGCAACTCTCAGCAAAGAAATTCGTCCAGTCTGCAAGAAATTCATGCAAGATCCGATGGAAGTGTACGTTGATGACGAGGCCAAGCTGACGCTTCACGGCCTGCAGCAGCCATATGTCAAACTCAAAGAAAACGAAAAGAACAAAAAGTTATTTGAATTACTTGACATACTTGAATTCAACCAGGTTGTTATATTTGTGAAGTCAGTGCAGCGCTGCATGGCCCTATCGCAACTCCTAACAGAGCAGAACTTCCCTGCAGTGCTATTCACCGTGG |
| NL008 | SEQ ID NO: 1608 GCGTAATACGACTCACTATAGGGATGCTGGAGACCTGGAGGTG SEQ ID NO: 1610 GATGCTGGAGACCTGGAGGTG | SEQ ID NO: 1609 GAGCGAGTCTACAAAATTGCCG SEQ ID NO: 1611 GCGTAATACGACTCACTATAGGGAGCGAGTCTACAAAATTGCCG | SEQ ID NO: 1607 GATGCTGGAGACCTGGAGGTGTATTAGATGTTTCAAACAGTTTTGCAGTTCCATTTGATGAGGACGACAAAGAAAAGAATGTTTGGTTCTTAGACCATGATTACTTGGAAAACATGTTCGGGATGTTCAAGAAAGTTAATGCTAGAGAAAAGGTTGTGGGTTGGTACCATACTGGACCCAAACTCCACCAAAACGATGTTGCAATCAATGAGTTGATTCGTCGTTACTGTCCAAACTGTGTCTTAGTCATAATCGATGCCAAGCCTAAAGATTGGGTCTACCTACAGAGGCATACAGAGTCGTTGAAGAAATCCATGATGATGGATCGCCAACATCAAAAACATTTGAACATGTGATGAGTGAGGCAGAAGAGGCTGAGGAGATTGCGTTGAACATCTGTTGAGAGACATCAAAGATCAACAGTCGGGTCACTGTCACAGCGCGTCACAAATCAGCTGATGGGCTTGAAGGGCTTGCATCTGCAATTACAGGATATGCGAGACTATTTGAATCAGGTTGTCGAAGGAAAGTTGCCAATGAACCATCAAATCGTTTACCAACTGCAAGACATCTTCAACCTTCTACCCGATATCGGCCACGGCAATTTTGTAGACTCGCTC |
| NL009 | SEQ ID NO: 1613 GCGTAATACGACTCACTATAGGGCGACTATGATCGACCGCC SEQ ID NO: 1615 GCGACTATGATCGACCGCC | SEQ ID NO: 1614 GTGTAAGGGTAGAAGTAGCCCGG SEQ ID NO: 1616 GCGTAATACGACTCACTATAGGGTGTAAGGGTAGAAGTAGCCCGG | SEQ ID NO: 1612 GCGACTATGATCGACCGCCGGGACGCGGTCAGGTGTGCGACGTCGACGTCAAGAACTGGTTTCCCTGCACCTCTGAGAACAATTTCAACTACCATCAATCGAGCCCTTGTGTTTTTCCAAACTGAACAAGATAATTGGTTGGCAACGGATACTACAATGAGACTGAAGGCTTTCAGATAATATGCCAGGTGACCTCAAGCGACACATTGCCCAACAGAAGAGTATCAACAAGCTGTTTATGCAAACAATCTGGATAACTTGCGAAGGAGAGGGTCCTCTAGACAAGGAGAATGCAGGGGAGATCCAGTACATCCCTAGACAGGGATTTCCGGGCTACTTCTACCCTTACAC |
| NL010 | SEQ ID NO: 1618 GCGTAATACGACTCACTATAGGGCTTGTTGTTCCCGTTGGATGTC SEQ ID NO: 1620 GCTTGTTGTTCCCGTT | SEQ ID NO: 1619 GCAACTCCAGTAGATCGGAGAGGTC SEQ ID NO: 1621 GCGTAATACGACTCACTATAGGGCAA | SEQ ID NO: 1617 GCTTGTTGTTCCCGTTGGATGTCTGTATCAACCTTTGAAGGAGAGACCTGATCTACCGCCTGTACAGTACGATCCAGTTCTTTGTACTAGGAATACTTGTCGTGCAATTCTGAATCCATTGTGCCAAGTCGACTATCGAGCCAAGCTATGGGTCTGCAACTTTTGTTTCCAGAGGAATCCTTTCCCCCCTCAATATGCAGCTATTTCGGAGCAGCATCAACCAGCAGAACTGATACCTTCATTTTTCCACCATCGAATACATCATTACCAGAGCGCAAAC |

TABLE 8-NL-continued

| Target ID | Primers Forward 5' → 3' | Primers 5' → 3' | Reverse dsRNA DNA Sequence 5' → 3' |
|---|---|---|---|
| | GGATGTC | CTCCAGTAGATCG GAGAGGTC | GATGCCGCCGATGTTCGTGCTGGTGGTGGACACATGTCTGGACGACGAGGAGCT GGGAGCTTTGAAGGACTCACTGCAGATGTCGCTGTCGCTGCTGCCGCCCAATGC ACTCATCGGTCTCATCACGTTCGGCAAAATGGTGCAGGTCACGAGCTTGGCTGC GACGGTGCTCGAAGAGCTACGTGTTCCGTGGCGTGAAGGACCTGACTGCCAAG CAGATCCAGGACATGTTGGGCATTGGCAAGATGGCCGCCGCTCCACAGCCCATG CAACAGCGCATTCCCGGCGCCGCTCCCTCCGCACCTGTCAACAGATTCTTCAGC CTGTCGGAAAGTGCGATATGAGTTTAACTGATCTGCTTGGGGAATTGCAAAGAGA TCCATGGAATGTGGCTCAGGGCAAGAGACCTCTCCGATCTACTGGAGTTGC |
| NL011 | SEQ ID NO: 1623 CCCACTTTCAAGTGY GTRYTRGTCGG SEQ ID NO: 1625 GTTGCCACCCTTGGA GTTGAAG | SEQ ID NO: 1624 GTCCATTGTGACC TCGGGAGG SEQ ID NO: 1626 GCGTAATACGACT CACTATAGGGTCC ATTGTGACCTCGG GAGG | SEQ ID NO: 1622 GTTGCCACCCTTGGAGTTGAAGTTCACCCCCTTGTATTTCACACAAACAGAGGTG TGATTAGGTTCAATGTGTGGGACACAGCTGGCCAGGAAAAGTTCGGTGGACTTCG TGATGGATATTACATTCAGGGACAATGCGCCATCATTATGTTTGACGTAACGTCAA GAGTCACCTACAAGAACGTTCCCAACTGGCACAGAGATTTAGTGAGGGTTTGCGA AAACATTCCCATTGTACTATGCGGCAACAAAGTAGACATCAAGGACAGGAAAGTC AAGGCCAAGAGCATAGTCTTCCATAGGAAGAAGAACCTTCAGTACTACGACATCA GTGCGAAAAGCAACTACAACTTCGAGAAGCCGTTCCTGTGGTTGGCAAAGAAGCT GATCGGTGACCCCAACCTGGAGTTCGTCGCCATGCCCGCCCTCCTCCCACCCGA GGTCACAATGGAC |
| NL012 | SEQ ID NO: 1628 GCGTAATACGACTCA CTATAGGGCAGCAGA CGCAGGCACAGGTAG SEQ ID NO: 1630 GCAGCAGACGCAGGC ACAGGTAG | SEQ ID NO: 1629 GAATTTCCTCTTGA GTTTGCCAGCTTG SEQ ID NO: 1631 GCGTAATACGACT CACTATAGGGAAT TTCCTCTTGAGTTT GCCAGCTTG | SEQ ID NO: 1627 GCAGCAGACGCAGGCACAGGTAGACGAGGTTGTCGATATAATGAAAACAAACGTT GAGAAAGTATTGGAGAGGGATCAAAAACTATCAGAATTGGATGATCGAGCAGATG CTCTACAGCAAGGCGCTTCACAGTTTGAACAGCAAGCTGGCAAACTCAAGAGGAA ATTC |
| NL013 | SEQ ID NO: 1633 GCGTAATACGACTCA CTATAGGCGCAGAGC AAGTCTACATCTCTTC SEQ ID NO: 1635 CGCAGAGCAAGTCTA CATCTCTTC | SEQ ID NO: 1634 GGCAACGGCTCTC TTGGATAG SEQ ID NO: 1636 GCGTAATACGACT CACTATAGGGCA ACGGCTCTCTTGG ATAG | SEQ ID NO: 1632 CGCAGAGCAAGTCTACATCTCTTCACTGGCCTTATTGAAAATGCTTAAGCACGGTC GCGCCGGTGTTCCCATGGAAGTTATGGGCCTAATGCTGGGCGAATTTGTAGACG ACTACACTGTGCGTGTCATTGATGTATTCGCTATGCCACAGAGTGGAACGGGAGT GAGTGTGGAGGCTGTAGACCCGGTGTTCCAAGCGAAGATGTTGGACATGCTAAA GCAGACAGGCGCCCAGATGGTGGTGGGCTGGTACCACTCGCACCCGGGCT TCGGCTGCTGGCTGTCGGGTGTCGACATCAACACGCAGGAGAGCTTCGAGCAAC TATCCAAGAGAGCCGTTGCC |
| NL014 | SEQ ID NO: 1638 GCGTAATACGACTCA CTATAGGCATTGAGC AAGAAGCCAATGAG SEQ ID NO: 1640 CATTGAGCAAGAAGC CAATGAG | SEQ ID NO: 1639 GAGCGCGACTCTA ATCTCGG SEQ ID NO: 1641 GCGTAATACGACT CACTATAGGGAGC GCGACTCTAATCT CGG | SEQ ID NO: 1637 CATTGAGCAAGAAGCCAATGAGAAAGCCGAAGAGATCGATGCCAAGGCCGAGGA AGAATTCAACATTGAAAAGGGAAGGCTCGTACAGCACCAGCGCCTTAAAATCATG GAGTACTATGACAGGAAAGAGAAGCAGGTTGAGCTCCAGAAAAAAATCCAATCGT CAAACATGCTGAACCGCGTCTGAAGGCACTGAAGGTGCGCGAAGATCACG TGAGAAGTGTGCTCGAAGAATCCAGAAAACGTCTTGGAGAAGTAACCAGAAACCC AGCCAAGTACAAGGAAGTCCTCCAGTATCTAATTGTCCAAGGACTCCTGCAGCTG CTAGAATCAAACGTAGTACTGCGCGTGCGCGAGGCTGACGTGAGTCTGATCGAG GCATTGTTGGCTCATCGCAGAGCAGTACGCGAAGATGACCGGCAAAGAGGTG GTGGTGAAGCTGGACGCTGACAACTTCCTGGCCGCCGAGACGTGTGGAGGCGTC GAGTTGTTCGCCCGCAACGGCCGCATCAAGATCCCCAACACCCTCGAGTCCAGG CTCGACCTCATCTCCCAGCAACTTGTGCCCGAGATTAGAGTCGCGCTC |
| NL015 | SEQ ID NO: 1643 GCGTAATACGACTCA CTATAGGCTGCGAGT GCGCTTGTCCG SEQ ID NO: 1645 CTGCGAGTGCGCTTG TCCG | SEQ ID NO: 1644 GGCCAAAGCGCCT AAGCGC SEQ ID NO: 1646 GCGTAATACGACT CACTATAGGGGCC AAAGCGCCTAAGC GC | SEQ ID NO: 1642 CTGCGAGTGCGCTTGTCCGACATTGTCTCGATCCAGCCTTGCCCAGACGTCAAGT ATGGAAAGCGTATCCATGTGCTGCCCATTGATGATACCGTTGAGGGTCTTACAGG AAATGTCTTGTCGAAGTGTATTTGAAGCCATACTTCCTGGAAGCATACAGGCCAATTC ACAAGGATGATGCATTCATTGTTCGCGGAGGTATGAGAGCGGTCGAATTCAAGGT GGTTGAAACAGATCCATCGCCCTACTGCATTGTCGCGCCAGACACCGTCATCCAT TGTGAGGGAGACCCCATCAAACGTGAGGATGAAGAAGACGCAGCAAACGCAGTC GGCTACGACGACATTGGAGGCTGCAGAAAGCAGCTGGCGCAGATCAAAGAGATG GTGGAGTTGCCGCTGAGACATCCCAGTCTGTTCAAGGCGATCGGCGTGAAGCCG CCACGAGGCATCCTGCTGTACGACCACCGGGAACCGGAAAGACGTTGATAGCG CGCGCCGTCGCCAACGAAACGGGCGCCTTCTTCTTCCTCATCAACGGACCCGAG ATTATGAGCAAATTGGCCGGCGAGTCGGAGAGTAACCTGCGCAAAGCTTTCGAG GAAGCGGACAAAAACGCACCGGCCATCATCTTCATCGATGAGCTGGACGCAATC GCGCCAAAACGCGAGAAGACGCACGCGAGGTGGAGCGACGCATCGTGTCGCA GCTGCTGACGCTGATGGACGGTCTCAAGCAGAGCTCGCACGTGATTGTCATGGC CGCCACCAATCGGCCCAACTCGATCGATGCCGCGCTTAGGCGCTTTGGCC |
| NL016 | SEQ ID NO: 1648 GCGTAATACGACTCA CTATAGGGACGCCAG TATCAGAAGACATGC SEQ ID NO: 1650 GACGCCAGTATCAGA AGACATGC | SEQ ID NO: 1649 GATGGAGCCGTTG CGACC SEQ ID NO: 1651 GCGTAATACGACT CACTATAGGGATG GAGCCGTTGCGAC C | SEQ ID NO: 1647 GACGCCAGTATCAGAAGACATGCTTGGTCGTGTATTCAACGGAAGTGGTAAGCCC ATCGACAAAGGACCTCCCATTCTTGCTGAGGATTATCTCGACATTCAAGGTCAACC CATCACTCTTGGTCGCGTATCTATCCCGAGGAAATGATCCAGACTGGAATTTCA GCCATCACGTCATGAACTCGATTGCTCGTGGCCAGAAAATCCCCATCTTTTCAG CTGCCGGTCTACCTCACAACGAAATTGCTGCTCAAATCTGTAGACAGGCTGGTCT TGTCAAACTGCCAGGAAAGTCAGTTCTCGATGACTCTGAGGACAACTTTGCTATTG TATTCGCAGCCATGGGAGTCAACATGGAAACTGCTCGATTCTTCAAACAGGATTTC GAGGAGAACGGCTCTATGGAGAACGTGTGCCTGTTCTTGAACCTGGCGAACGAC |

TABLE 8-NL-continued

| Target ID | Primers Forward 5' → 3' | Primers 5' → 3' | Reverse dsRNA DNA Sequence 5' → 3' |
|---|---|---|---|
| | | | CCGACGATCGAGCGTATCATCACACCACGCCTGGCGCTGACGGCCGCCGAGTTC CTGGCCTACCAGTGCGAGAAGCACGTGCTCGTCATCCTCACCGACATGAGCTCC TACGCCGAGGCGCTGCGAGAGGTGTCCGCCGCCCGCGAGGAGGTGCCCGGCC GTCGTGGTTTCCCCGGTTACATGTACACCGATCTGGCCACCATCTACGAGCGCGC CGGACGAGTCGAGGGTCGCAACGGCTCCATC |
| NL018 | SEQ ID NO: 1653 GCGTAATACGACTCA CTATAGGGCAAATGC CTGTGCCACGC SEQ ID NO: 1655 GCAAATGCCTGTGCC ACGC | SEQ ID NO: 1654 GCAATACAGCCGA CCCACTCCG SEQ ID NO: 1656 GCGTAATACGACT CACTATAGGGCAA TACAGCCGACCAC TCCG | SEQ ID NO: 1652 GCAAATGCCTGTGCCACGCCCACAAATAGAAAGCACACAACAGTTTATTCGATCC GAGAAAACAACATACTCGAATGGATTCACCACCATTGAGGAGGACTTCAAAGTAG ACACTTTCGAATACCGTCTTCTGCGCGAGGTGTCGTTCCGCGAATCTCTGATCAG AAACTACTTGCACGAGGCGGACATGCAGATGTCGACGGTGGTGGACCGAGCATT GGGTCCCCCCTCGGCGCCACACATCCAGCAGAAGCCGCGCAACTCAAAAATCCA GGAGGGCGGCGATGCCGTCTTTTCCATCAAGCTCAGCGCCAACCCCAAGCCTCG GCTGGTCTGGTTCAAGAACGGTCAGCGTCCGTCGTTCAGACGCAGAAACACCAGGC CTCCTACTCCAATCAGACCGCCACGCTCAAGGTCAACAAAGTCAGCGCTCAAGAC TCCGGCCACTACACGCTGCTTGCTGAAAATCCGCAAGGATGTACTGTGTCCTCAG CTTACCTAGCTGTCGAATCAGCTGGCACTCAAGATACAGGATACAGTGAGCAATA CAGCAGACAAGAGGTGGGAGACGACAGGGCGGTGGACAGCAGCAAGATGCTGG CACCGAACTTTGTTCGCGTGCCGGCCGATCGCGACGCGAGCGAAGGCAAGATGA CGCGGTTTGACTGCCGCGTGACGGGCCGACCCTACCCGGACGTGGCCTGGTTC ATCAACGGCCAACAGGTGGCTGACGACGCCACGCACAAGATCCTCGTCAACGAG TCTGGCAACCACTCGCTCATGATCACCGGCGTCACTCGCTTGGACCACGGAGTG GTCGGCTGTATTGC |
| NL019 | SEQ ID NO: 1658 GCGTAATACGACTCA CTATAGGGCTTCAGA TTTGGGACACGGC SEQ ID NO: 1660 GCTTCAGATTTGGGA CACGGC | SEQ ID NO: 1659 GAACGCCTGCTCC ACATTGG SEQ ID NO: 1661 GCGTAATACGACT CACTATAGGGAAC GCCTGCTCCACAT TGG | SEQ ID NO: 1657 GCTTCAGATTTGGGACACGGCCGGCCAGGAGCGGTTCCGCACGATCACATCGAG CTACTACCGGGGCGCCCACGGCATCATTGTGGTGTACGACTGCACCGACCAGGA GTCGTTCAACAACCTCAAACAGTGGCTCGAGGAGATTGACCGCTACGCCTGTGAT AATGTCAACAAACTGCTCGTCGGCAACAAGTGTGATCAGACCAACAAAAAGGTCG TCGACTATACACAGGTAAGGAATACGCCGACCAGCTGGGCATTCCGTTCCTGGA GACGTCGGCGAAGAACGCGACCAATGTGGAGCAGGCGTTC |
| NL021 | SEQ ID NO: 1663 GCGTAATACGACTCA CTATAGGCGTCAGTC TCAATTCTGTCACCG SEQ ID NO: 1665 CGTCAGTCTCAATTCT GTCACCG | SEQ ID NO: 1664 CTTCTAGTTCATCC AGGTCGCG SEQ ID NO: 1666 GCGTAATACGACT CACTATAGGCTTCT AGTTCATCCAGGT CGCG | SEQ ID NO: 1662 CGTCAGTCTCAATTCTGTCACCGATATCAGCACCACGTTCATTCTCAAGCCACAAG AGAACGTGAAGATAACGCTTGAGGGCGCACAGGCCTGTTTCATTTCACACGAACG ACTTGTGATCTCACTGAAGGGAGGAGAACTCTATGTTCTAACTCTCTATTCCGATA GTATGCGCAGTGTGAGGAGTTTTCATCTGGAGAAAGCTGCTGCCAGTGTCTTGAC TACTTGTATCTGTGTTTGTGAGGAGAACTATCTGTTCCTTGGTTCCCGTCTTGGAA ACTCACTGTTGCTCAGGTTTACTGAGAAGGAATTGAACCTGATTGAGCCGAGGGC CATCGAAAGCTCACAGTCCCAGAATCCGGCCAAGAAGAAAAAGCTGGATACTTTG GGAGATTGGATGCATCTGACGTCACTGAAATACGCGACCTGGATGAACTAGAAG |
| NL022 | SEQ ID NO: 1668 GCGTAATACGACTCA CTATAGGCTCACGAG AGGACGTTGCACAC SEQ ID NO: 1670 CTCACGAGAGGACGT TGCACAC | SEQ ID NO: 1669 CAGACGGAAGCAC TTGCCG SEQ ID NO: 1671 GCGTAATACGACT CACTATAGGCAGA CGGAAGCACTTGC CG | SEQ ID NO: 1667 CTCACGAGAGGACGTTGCACACTGATATACTGTTCGGTTTGGTGAAAGATGTCGC CCGATTCAGACCTGACTTGAAGCTGCTCATATCAAGCGCCACACTGGATGCTCAG AAATTCTCCGAGTTTTTCGACGATGCACCCATCTTCAGGATTCCGGGCCGTAGATT TCCGGTGGACATCTACTACACAAAGGCGCCCGAGGCTGACTACGTGGACGCATG TGTCGTTTCGATCCTGCAGATCCACGCCACTCAGCCGCTGGGAGACATCCTGGTC TTCCTCACCGGTCAGGAGGAGATCGAAACCTGCCAGGAGCTGCTGCAGGACAGA GTGCGCAGGCTTGGGTCTCGTATCAAGGAGCTGCTCATATTGCCCGTCTATTCCA ACCTACCCAGTGATATGCAGGCAAAGATTTTCCTGCCCACTCCACCAAATGCTAG AAAGGTAGTATTGGCCACAAATATTGCAGAAACCTCATTGACCATCGACAATATAA TCTACGTGATTGATCCTGGTTTTTGTAAGCAGAATAACTTCAATTCAAGGACTGGA ATGGAATCGCTTGTTGTAGTGCCTGTTTCAAAGGCATCGGCCAATCAGCGAGCAG GGCGGGCGGGACGGGTGGCGGCCGGCAAGTGCTTCCGTCTG |
| NL023 | SEQ ID NO: 1673 GCGTAATACGACTCA CTATAGGGTCCTCGG ACGGGAGGTCC SEQ ID NO: 1675 GTCCTCGGACGGGAG GTCC | SEQ ID NO: 1674 GCAATGTTGTCCTT GAGCCAGC SEQ ID NO: 1676 GCGTAATACGACT CACTATAGGGCAA TGTTGTCCTTGAG CCAGC | SEQ ID NO: 1672 GTCCTCGGACGGGAGGTCCACGTGTTTACCGGGATTCCGTTTGCGAAACCTCCC ATCGGTCGTTGCGATTCCGTAAACCGGTTCCCGTCGACCCGTGGCACGAGCGTT CTGGATGCGACCGCGCTTCCCAACAGCTGCTACCAGGAACGGTACGAGTATTTC CCGGGCTTCGAGGGAGAGGAAATGTGGAATCCGAATACGAATTTGTCCGAAGATT GTCTGTATTTGAACATATGGGTGCCGCACCGGTTGAGAATCCGACACAGAGCCAA CAGCGAGGAGAATAAACCAAGAGCGAAGGTGCCGGTGCTGATCTGGATCTACGG CGGGGGTTACATGAGCGGCACAGCTACACTGGACGTGTACGATGCTGACATGGT GGCCGCCACGAGTGACGTCATCGTCGCCTCCATGCAGTACCGAGTGGGTGCGTT CGGCTTCCTCTACCTCGCACAGGACTTGCCTCGAGGCAGCGAGGAGGCGCCGG CAACATGGGCTCTGGGACCAGGCCCTTGCCATCCGCTGGCTCAAGGACAACA TTGC |
| NL027 | SEQ ID NO: 1678 GCGTAATACGACTCA CTATAGGAGAAGACG GCACGGTGCG SEQ ID NO: 1680 AGAAGACGGCACGGT | SEQ ID NO: 1679 CAATCCAGTTTTTA CAGTTTCGTGC SEQ ID NO: 1681 GCGTAATACGACT CACTATAGGCAAT | SEQ ID NO: 1677 AGAAGACGGCACGGTGCGTATTTGGCACTCGGGCACCTACAGGCTGGAGTCCTC GCTGAATTATGGCCTCGAAAGAGTGTGGACCATTTGCTGCATGCGAGGATCCAAC AATGTGGCTCTTGGCTACGACGAAGGCAGCATAATGGTGAAGGTGGGTCGGGAG GAGCCGGCCATCTCGATGGATGTGAACGGTGAGAAGATTGTGTGGGCGCGCCAC TCGGAGATACAACAGGTCAACCTCAAGGCCATGCCGGAGGCGTCGAAATCAAA |

TABLE 8-NL-continued

| Target ID | Primers Forward 5' → 3' | Primers 5' → 3' | Reverse dsRNA DNA Sequence 5' → 3' |
|---|---|---|---|
| | GCG | CCAGTTTTTACAGT TTCGTGC | GATGGCGAACGACTGCCGGTCGCCGTTAAGGATATGGGCAGCTGTGAAATATAT CCGCAGACCATCGCTCATAATCCCAACGGCAGATTCCTAGTCGTTTGTGGAGATG GAGAGTACATAATTCACACATCAATGGTGCTAAGAAATAAGGCGTTTGGCTCGGC CCAAGAGTTCATTTGGGGACAGGACTCGTCCGAGTATGCTATCAGAGAAGGAACA TCCACTGTCAAAGTATTCAAAAACTTCAAAGAAAAGAAATCATTCAAGCCAGAATTT GGTGCTGAGAGCATATTCGGCGGCTACCTGCTGGGAGTTTGTTCGTTGTCTGGAC TGGCGCTGTACGACTGGGAGACCCTGGAGCTGGTGCGTCGCATCGAGATCCAAC CGAAACACGTGTACTGGTCGGAGAGTGGGGAGCTGGTGGCGCTGGCCACTGAT GACTCCTACTTTGTGCTCCGCTACGACGCACAGGCCGTGCTCGCTGCACGCGAC GCCGGTGACGACGCTGTCACGCCGGACGGCGTCGAGGATGCATTCGAGGTCCTT GGTGAAGTGCACGAAACTGTAAAAACTGGATTG |

TABLE 8-CS

| Target ID | Primers Forward 5' → 3' | Primers Reverse 5' → 3' | dsRNA DNA Sequence (sense strand) 5' → 3' |
|---|---|---|---|
| CS001 | SEQ ID NO: 2041 TAAAGCATGGATGTT GGACAAACTGGG SEQ ID NO: 2043 GCGTAATACGACTC ACTATAGGTAAAGC ATGGATGTTGGACA AACTGGG | SEQ ID NO: 2042 GCGTAATACGACTC ACTATAGGGGTGAG TCGCACGCCCTTGC C SEQ ID NO: 2044 GGTGAGTCGCACGC CCTTGCC | SEQ ID NO: 2040 TAAAGCATGGATGTTGGACAAACTGGGTGGCGTGTACGCGCCGCGGCCGTCGAC CGGCCCCCACAAGTTGCGCGAGTGCCTGCCGCTGGTGATCTTCCTCAGGAACCG GCTCAAGTACGCGCTCACCGGAAATGAAGTGCTTAAGATTGTAAAGCAGCGACTT ATCAAAGTTGACGGCAAAGTCAGGACGACCCCCACATATCCCGCTGGATTTATGG ATGTTGTTTCCATTGAAAAGACAAATGAGCTGTTCCGTCTTATATATGATGTCAAAG GCAGATTTACTATTCACCGTATTACTCCTGAGGAGGCTAAATACAAGCTGTGCAAG GTGCGGCGCGTGGCGACGGGCCCCAAGAACGTGCCTTACCTGGTGACCCACGA CGGACGCACCGTGCGATACCCCGACCCACTCATCAAGGTCAACGACTCCATCCA GCTCGACATCGCCACCTCCAAGATCATGGACTTCATCAAGTTTGAATCTGGTAAC CTATGTATGATCACGGAGGCCGTAACTTGGGGCGCGGTGGGCACCATCGTGTCC CGCGAGCGACATCCCGGGTCCTTCGACATCGTGCATATACGGGACTCCACCGGA CATACCTTCGCTACCAGATTGAACAACGTGTTCATAATCGGCAAGGGCACGAAGG CGTACATCTCGCTGCCGCGCGGCAAGGGCGTGCGACTCACC |
| CS002 | SEQ ID NO: 2046 CAAGAAGGAGGAGA AGGGTCCATCAAC SEQ ID NO: 2048 GCGTAATACGACTC ACTATAGGCAAGAA GGAGGAGAAGGGTC CATCAAC | SEQ ID NO: 2047 GCGTAATACGACTC ACTATAGGCTTGTCT ACATCGATATCCTTG TGGGC SEQ ID NO: 2049 CTTGTCTACATCGAT ATCCTTGTGGGC | SEQ ID NO: 2045 CAAGAAGGAGGAGAAGGGTCCATCAACACACGAAGCTATACAGAAATTACGCGAA ACGAAGAGTTATTCAGAAGAAACAAGAGTTTCTAGAGCGAAAGATCGACACTG AATTACAAACGGCGAGAAAACATGGCACAAAGAATAAGAGAGCTGCCATTGCGGC ACTGAAGCGCAAGAAGCGTTATGAAAAGCAGCTTACCCAGATTGATGGCACGCTT ACCCAAATTGAGGGCCCAAAGGGAAGCGCTAGAAGGAGCTAACACCAATACACAG GTGCTTAACACTATGCGAGATGCTGCTACCGCTATGAGACTCGCCCACAAGGATA TCGATGTAGACAAG |
| CS003 | SEQ ID NO: 2051 TGGTCTCCGCAACA AGCGTGAGG SEQ ID NO: 2053 GCGTAATACGACTC ACTATAGGTGGTCT CCGCAACAAGCGTG AGG | SEQ ID NO: 2052 GCGTAATACGACTC ACTATAGGCTGGAACG GAGACTTCAGCGAG AAGTCA SEQ ID NO: 2054 CGAACGGAGACTTC AGCGAGAAGTCA | SEQ ID NO: 2050 TGGTCTCCGCAACAAGCGTGAGGTGTGGAGGGTGAAGTACACGCTGGCCAGGAT CCGTAAGGCTGCCCGTGAGCTGCTCACACTCGAGGAGAAAGACCCTAAGAGGTT ATTCGAAGGTAATGCTCTCCTTCGTCGTCTGGTGAGGATCGGTGTGTTGGATGAG AAGCAGATGAAGCTCGATTATGTACTCGGTCTGAAGATTGAGGACTTCTTGGAAC GTCGTCTCCAGACTCAGGTGTTCAAGGCTGGTCTAGCTAAGTCTATCCATCATGC CCGTATTCTTATCAGACAGAGGCACATCCGTGTCCGCAAGCAAGTTGTGAACATC CCTTCGTTCATCGTGCGGCTGGACTCTGGCAAGCACATTGACTTCTCGCTGAAGT CTCCGTTCG |
| CS006 | SEQ ID NO: 2056 GGATGATGATGGTA TAATTGCACCAGGG SEQ ID NO: 2058 GCGTAATACGACTC ACTATAGGGATGA TGATGGTATAATTGC ACCAGGG | SEQ ID NO: 2057 GCGTAATACGACTC ACTATAGGCGTTAAA TGGTGTAGCATCAC CTATTTCACC SEQ ID NO: 2059 CGTTAAATGGTGTA GCATCACCTATTTCA CC | SEQ ID NO: 2055 GGATGATGATGGTATAATTGCACCAGGGATTCGTGTATCTGGTGACGATGTAGTC ATTGGAAAAACTATAACTTTGCCAGAAAACGATGATGAGCTGGAAGGAACATCAA GACGATACAGTAAGAGAGATGCCTCTACATTCTTGCGAAACAGTGAAACTGGTATT GTTGACCAAGTTATGCTTACACTTAACAGCGAAGGATACAAATTTTGTAAAATACG TGTGAGATCTGTGAAATCCCACAAATTCAGGACAAATTTGCTTCTCGTCATGGTC AAAAAGGGACTTGTGGTATTCAATATAGGCAAGAAGATATGCCTTTCACTTGTGAA GGATTGACACCAGATATTATCATCAATCCACATGCTATCCCCTCTCGTATGACAAT TGGTCACTTGATTGAATGTATTCAAGGTAAGGTCTCCTCAAATAAAGGTGAAATAG GTGATGCTACACCATTTAACG |
| CS007 | SEQ ID NO: 2061 CTTGTTGAAACCAG AGATTTTGAGGGC SEQ ID NO: 2063 GCGTAATACGACTC ACTATAGGCTTGTTG AAACCAGAGATTTTG AGGGC | SEQ ID NO: 2062 GCGTAATACGACTC ACTATAGGCGTTAAA GTCATAATTGAAGAC TATGTTGACTC SEQ ID NO: 2064 CGGCATGTCATAATT GAAGACTATGTTGA CTC | SEQ ID NO: 2060 CTTGTTGAAACCAGAGATTTTGAGGGCTATCGTCGATTGCGGTTTCGAGCACCCT TCAGAACTTCAACATGAATGTATTCCCCAAGCTGTTTGGGAATGGATATTCTTTG TCAAAGCTAAATCCGGAATGGGAAAAACCGCCGTATTTGTTTTAGCAACACTGCAA CAGCTAGAACCTTCAGAAAACCATGTTTACGTATTAGTAATGTGCCATACAAGGGA ACTCGCTTTCCAAATAAGCAAGGAATATGAGAGGTTCTCTAAATATATGGCTGGTG TTAGATATCTGTATTCTTTGGGATGCCAATTCAGAAGATGAAGAAGTATTG AAGACAGCTGCCCGCACACTCGTTGTTGGTACTCCTGGCAGAATATTAGCATTGG TTAACAACAAGAAACTGAATTTAAAACACCTGAAACACTTCATCCTGGATGAATGT GACAAAATGCTTGAATCTCTAGACATGAGACGTGATGTGCAGGAAATATTCAGGA ACACCCCTCACGGTAAGCAGGTCATGATGTTTTCTGCAACATTGAGTAAGGAGAT CAGACCAGTCTGTAAGAAATTTATGCAAGATCCTATGGAAGTTTATGTGGATGATG |

TABLE 8-CS-continued

| Target ID | Primers Forward 5' → 3' | Primers Reverse 5' → 3' | dsRNA DNA Sequence (sense strand) 5' → 3' |
|---|---|---|---|
| | | | AAGCTAAACTTACATTGCACGGTTTGCAGCAACATTATGTTAAACTCAAGGAAAAT GAAAAGAATAAGAAGTTATTTGAACTTTTGGATGTACTGGAGTTCAACCAAGTTGT CATATTTGTAAAGTCAGTGCAGCGCTGCATAGCTCTCGCACAGCTGCTGACAGAC CAAAACTTCCCAGCTATTGGTATACACCGAAATATGACTCAAGATGAGCGTCTCTC CCGCTATCAGCAGTTCAAAGATTTCCAGAAGAGGATCCTTGTTGCGACAAATCTTT TTGGACGGGGTATGGACATTGAAAGAGTCAACATAGTCTTCAATTAT GACATGCCG |
| CS009 | SEQ ID NO: 2066 ACGTTTCTGCAGCG GCTGGACTC SEQ ID NO: 2068 GCGTAATACGACTC ACTATAGGACTTTC TGCAGCGGCTGGAC TC | SEQ ID NO: 2067 GCGTAATACGACTC ACTATAGGGATAATT CTTATCGTACGCTGT CATATTCCTG SEQ ID NO: 2069 GATAATTCTTATCGT ACGCTGTCATATTCC TG | SEQ ID NO: 2065 ACGTTTCTGCAGCGGCTGGACTCACGGGAGCCCATGTGGCAGCTGGACGAGAGC ATCATCGGCACCAACCCCGGGCTCGGCTTCCGGCCCACGCCGCCAGAGGTCGC CAGCAGCGTCATCTGGTATAAAGGCAACGACCCCAACAGCCAACAATTCTGGGTG CAAGAAACCTCCAACTTTCTAACCGCGTACAAACGAGACGGTAAGAAAGCAGGAG CAGGGCCAGAACATCCACAACTGTGATTTCAAACTGCCTCCTCCGGCCGGTAAGGT GTGCGACGTGGACATCAGCGCCTGGAGTCCCTGTGTAGAGGACAAGCACTTTGG ATACCACAAGTCCACGCCCTGCATCTTCCTCAAACTCAACAAGATCTTCGGCTGG AGGCCGCACTTCTACAACAGCTCCGACAGCCTGCCCACTGACATGCCCGACGAC TTGAAGGAGCACATCAGGAATATGACAGCGTACGATAAGAATTATC |
| CS011 | SEQ ID NO 2071 CGACACTTGACTGG AGAGTTCGAGA SEQ ID NO: 2073 GCGTAATACGACTC ACTATAGGCGACAC TTGACTGGAGAGTT CGAGA | SEQ ID NO: 2072 GCGTAATACGACTC ACTATAGGCTCTAG GTTACCATCACCGA TCAACT SEQ ID NO: 2074 CTCTAGGTTACCATC ACCGATCAACT | SEQ ID NO: 2070 CGACACTTGACTGGAGAGTTCGAGAAAAGATATGTCGCCACATTAGGTGTCGAGG TGCATCCCTTAGTATTCCACACAAATAGAGGCCCTATAAGGTTTAATGTATGGGAT ACTGCTGGCCAAGAAAAGTTTGGTGGTCTCCGAGATGGTTACTATATCCAAGGTC AATGTGCCATCATCATGTTCGATGTAACGTCTCGTGTCACCTACAAAAATGTACCC AACTGGCACAGAGATTTAGTGCGAGTCTGTGAAGGCATTCCAATTGTTCTTTGTG GCAACAAAGTAGATATCAAGGACAGAAAAGTCAAAGCAAAAACTATTGTTTTCCAC AGAAAAAAGAACCTTCAGTATTATGACATCTCTGCCAAGTCAAACTACAATTTCGA GAAACCCTTCCTCTGGTTAGCGAGAAAGTTGATCGGTGATGGTAACCTAGAG |
| CS013 | SEQ ID NO: 2076 TGCCGAACAGGTAT ACATCTCGTCTTTGG SEQ ID NO: 2078 GCGTAATACGACTC ACTATAGGTGCCGA ACAGGTATACATCTC GTCTTTGG | SEQ ID NO: 2077 GCGTAATACGACTC ACTATAGGCCACTA CAGCTACAGCACGT TCAGAC SEQ ID NO: 2079 CCACTACAGCTACA GCACGTTCAGAC | SEQ ID NO: 2075 TGCCGAACAGGTATACATCTCGTCTTTGGCCCTGTTGAAGATGTTAAAACACGGG CGCGCCGGTGTTCCAATGGAAGTTATGGGACTTATGTTAGGTGAATTTGTTGATG ATTACACGGTGCGTGTCATAGACGTATTTGCCATGCCTCAAACTGGCACAGGAGT GTCGGTTGAAGCTGTAGATCCTGTCTTCCAAGCAAAGATGTTGGATATGTTGAAG CAAACTGCAGACCTGAGATGGTAGTGGGATGGTACCACTCGCATCCTGGCTTTG GATGTGGTTATCTGGAGTCGACATTAATACTCAGCAGTCTTTCGAAGCTTTGTCT GAACGTGCTGTAGCTGTAGTGG |
| CS014 | SEQ ID NO: 2081 CAGATCAAGCATAT GATGGCCTTCATCG A SEQ ID NO: 2083 GCGTAATACGACTC ACTATAGGCAGATC AAGCATATGATGGC CTTCATCGA | SEQ ID NO: 2082 GCGTAATACGACTC ACTATAGGGAACAA TGCGGTACGTATTT CGGGC SEQ ID NO: 2084 GAACAATGCGGTAC GTATTTCGGGC | SEQ ID NO: 2080 AGATCAAGCATATGATGGCCTTCATCGAACAAGAGGCTAATGAAAAGGCCGAGGA AATCGATGCAAAGGCCGAAGAGGAGTTCAACATTGAAAAAGGCCGCCTGGTGCA GCAGCAGCGGCTCAAGATCATGGAATACTACGAAAAGAAAGAGAAACAAGTGGAA CTCCAGAAAAAGATCCAATCTTCGAACATGCTGAATCAAGCCCGTCTGAAGGTGC TCAAAGTGCGTGAGGACCACGTACGCAACGTTCTCGACGAGGCTCGCAAGCGCC TGGCTGAGGTGCCCAAAGACGTGAAACTTTACACAGATCTGCTGGTCACGCTCGT CGTACAAGCCCTATTCCAGCTCATGGAACCCACAGTAACAGTTCGCGTTAGGCAG GCGGACGTCTCCTTAGTACAGTCCATATTGGGCAAGGCACAGCAGGATTACAAAG CAAAGATCAAGAAGGACGTTCAATTGAAGATCGACACCGAGAATTCCCTGCCCGC CGATACTTGTGGCGGAGTGGAACTTATTGCTGCTAGAGGGCGTATTAAGATCAGC AACACTCTGGAGTCTCGTCTGGAGCTGATAGCCCAACAACTGTTGCCCGAAATAC GTACCGCATTGTTC |
| CS015 | SEQ ID NO: 2086 ATCGTGCTTTCAGA CGATAACTGCCCC SEQ ID NO: 2088 GCGTAATACGACTC ACTATAGGATCGTG CTTTCAGACGATAAC TGCCCC | SEQ ID NO: 2087 GCGTAATACGACTC ACTATAGGCATTAC GATCACGTGCGATG ACTTC SEQ ID NO: 2089 CCATTACGATCACG TGCGATGACTTC | SEQ ID NO: 2085 ATCGTGCTTTCAGACGATAACTGCCCCGATGAGAAGATCCGCATGAACCGCGTCG TGCGAAAACTGCGTGTACGCCTGTCAGACATAGTCTCCATAGCGCCTTGTCC ATCGGTCAAATATGGGAAACGGGTACATATATTGCCCATTGATGATTCTGTCGAG GGTTTGACTGGAAATTTATTCGAAGTCTACTTGAAACCATACTTCATGGAAGCTTA TCGGCCTATCCATCGCGATGACACATTCATGGTTCGCGGGGGCATGAGGGCTGT TGAATTCAAAGTGGTGGAGACTGATCCGTCGCCGTATTGCATCGTCGCTCCCGAC ACAGTGATACACTGCGAAGGAGACCCTATCAACGAGAGGAAGAAGAAGAAGCC CTAAACGCCGTAGGGTACGACGACATCGGTGGCTGTCGTAAACAGCTCGCTCAG ATCAAAGAGATGGTCGAGTTGCCTCTAAGGCATCCGTCGCTGTTCAAGGCAATTG GTGTGAAGCCGCCACGTGGAATCCTCATGTATGGGCCGCCTGGTACCGGCAAAA CTCTCATTGCTCGGGCAGTGGCTAATGAAACTGGTGCATTCTTCTTTCTGATCAAC GGGCCGGAGATCATGTCCAAACTCGCGGGCGAGTCCGAATCGAACCTTCGCAAG GCATTCGAGGAAGCGGACAAGAACTCCCCGGCTATAATCTTCATCGATGAACTGG ATGCCATCGCACCAAAGAGGGAGAAGACTCACGGTGAAGTGGAGCGTCGTATTG TGTCGCAACTACTTACTCTTATGGATGGAATGAAGAAGTCATCGCACGTGATCGTA ATGG |
| CS016 | SEQ ID NO: 2091 AGGATGGAAGCGGG GATACGTTTGAG SEQ ID NO: 2093 GCGTAATACGACTC ACTATAGGAGGATG | SEQ ID NO: 2092 GCGTAATACGACTC ACTATAGGGCACCC CTGTCTCCGAAGAC ATGTT SEQ ID NO: 2094 | SEQ ID NO: 2090 AGGATGGAAGCGGGGATACGTTTGAGCATCTCCTTGGGGAAGATACGGAGCAGC TGCCAGCCGATGTCCAGCGACTCGAATACTGTGCGGTTCTCGTAGTTGCCCTGTG TGATGAAGTTCTTCTCGAACTTGGTGAGGAACTCGAGGTAGAGCAGATCGTCGGG TGTCAGGGCTTCCTCACCGACGACAGCCTTCATGGCCTGCACGTCCTTACCGATG GCGTAGCAGGCGTACAGCTGGTTGGAAACATCAGAGTGGTCCTTGCGGGTCATT |

TABLE 8-CS-continued

| Target ID | Primers Forward 5' → 3' | Primers Reverse 5' → 3' | dsRNA DNA Sequence (sense strand) 5' → 3' |
|---|---|---|---|
| | GAAGCGGGGATACG TTTGAG | GCACCCCTGTCTCC GAAGACATGTT | CCCTCACCGATGGCAGACTTCATGAGACGAGACAGGGAAGGCAGCACGTTTACA GGCGGGTAGATCTGTCTGTTGTGGAGCTGACGGTCTACGTAGATCTGTCCCTCAG TGATGTAGCCCGTTAAATCGGGAATAGGATGGGTGATGTCGTCGTTGGGCATAGT CAAGATGGGGATCTGCGTGATGGATCCGTTTCTACCCTCTACACGCCCGGCTCTC TCGTAGATGGTGGCCAAATCGGTGTACATGTAACCTGGGAAACCACGTCGTCCG GGCACCTCCTCACGGGCGGCGGACACTTCACGCAGAGCCTCCGCGTACGAAGA CATGTCAGTCAAGATTACCAGCACGTGTTTCTCACACTGGTAGGCCAAGAACTCA GCAGCAGTCAAGGCCAAACGTGGTGTGATGATTCTCTCAATAGTGGGATCGTTGG CCAGATTCAAGAACAGGCACACGTTCTCCATGGAGCCGTTCTCCTCGAAGTCCTG CTTGAAGAACCGGGCCGTCTCCATGTTCACACCCATGGCGGCGAACACGATGGC AAAGTTGTCCTCGTGGTCGTCCAGCACAGATTTGCCGGGGATCTTTACAAGACCG GCTTGCCTACAGATCTGGGCGGCAATTTCGTTGTGTGGCAGACCGGCAGCCGAG AAAATGGGGATCTTTTGCCCGCGAGCAATGGAGTTCATCACGTCGATAGCGGAGA TACCAGTCTGGATCATTTCCTCAGGGTAGATACGGGACCAGGGGTTGATGGGCT GTCCCTGGATGTCCAAAAAGTCTTCAGCAAGGATTGGGGGACCTTTGTCAATGGG TTTTCCAGAGCCGTTGAATACGCGACCCAACATGTCTTCGGAGACAGGGGTGC |
| CS018 | SEQ ID NO: 2096 CGTCCCTGTACCTG CTCAGCAATCCCA SEQ ID NO: 2098 GCGTAATACGACTC ACTATAGGCGTCCC TGTACCTGCTCAGC AATCCCA | SEQ ID NO: 2097 GCGTAATACGACTC ACTATAGGCAGCGT CGAGGCCCCACCTT SEQ ID NO: 2099 CAGCGTCGAGGCCC CACCTT | SEQ ID NO: 2095 CGTCCCTGTACCTGCTCAGCAATCCCAACAGCAGCAGAGTTACCGCCACGTCAG CGAGAGCGTCGAACACAAATCCTACGGCACGCAAGGGTACACCACTTCGGAACA GACCAAGCAGACACAGAAGGTGGCGTACACCAACGGTTCCGACTACTCTTCCAC GGACGACTTTAAGGTGGATACGTTCGAATACAGACTCCTCCGAGAAGTTTCGTTC AGGGAATCCATCACGAAGCGGTACATTGGCGAGACAGACATTCAGATCAGCACG GAGGTCGACAAGTCTCTCGGTGTGGTGACCCCTCCTAAGATAGCACAAAAGCCTA GGAATTCCAAGCTGCAGGAGGGAGCCGACGCTCAGTTTCAAGTGCAGCTGTCGG GTAACCCGCGGCCACGGGTGTCATGGTTCAAGAACGGGCAGAGGATAGTCAACT CGAACAAACACGAAATCGTCACGACACATAATCAAACAATACTTAGGGTAAGAAAC ACACAAAAGTCTGATACTGGCAACTACACGTTGTTGGCTGAAAATCCTAACGGAT GCGTCGTCACATCGGCATACCTGGCCGTGGAGTCGCCTCAAGAAACTTACGGCC AAGATCATAAATCACAATACATAATGGACAATCAGCAAACAGCTGTAGAAGAAAGA GTAGAAGTTAATGAAAAAGCTCTCGCTCCGCAATTCGTAAGAGTCTGCCAAGACC GCGATGTAACGGAGGGAAAATGACGCGATTCGATTGCCGCGTCACGGGCAGAC CTTACCCAGAAGTCACGTGGTTCATTAACGATAGACAAATTCGAGACGATTATWAT CATAAGATATTAGTAAACGAATCGTGTAATCATGCACTTATGATTACAAACGTCGAT CTCAGTGATAGTGGCGTAGTATCATGTATAGCACGCAACAAGACCGGCGAAACTT CGTTTCAGTGTAGGCTGAACGTGATAGAAGGAGCAAGTGGTCGCTCCCAAATT CGTGGAGCGGTTCAGCACGCTCAACGTGCGCGAGGGCGAGCCCGTGCAGCTGC ACGCGCGCCGTCGGCACGCCTACGCCACGCATCACATGGCAGAAGGACGGC GTTCAAGTTATACCCAATCCAGACTACGAATAAATACCGAAGGTGGGGCCTCGA CGCTG |

TABLE 8-PX

| Target ID | Primers Forward 5' → 3' | Primers Reverse 5' → 3' | dsRNA DNA Sequence (sense strand) 5' → 3' |
|---|---|---|---|
| PX001 | SEQ ID NO: 2340 GCGTAATACGACTC ACTATAGGCGAGGT GCTGAAGATCGTGA AG SEQ ID NO: 2342 CGAGGTGCTGAAGA TCGTGAAG | SEQ ID NO: 2341 CTTGCCGATGATGA ACACGTTG SEQ ID NO: 2343 GCGTAATACGACTC ACTATAGGCTTGCC GATGATGAACACGT TG | SEQ ID NO: 2339 CGAGGTGCTGAAGATCGTGAAGCAGCGCCTCATCAAGGTGGACGGCAAGGTCCG CACCGACCCCACCTACCCGGCTGGATTCATGGATGTTGTGTCGATTGAAAAGACC AATGAGCTGTTCCGTCTGATCTACGATGTGAAGGGACGCTTCACCATCCACCGCA TCACTCCCGAGGAGGCCAAGTACAAGCTGTGCAAGGTGAAGCGCGTGGCGACG GGCCCCAAGAACGTGCCGTACATCGTGACGCACAACGGCCGCACGCTGCGCTAC CCCGACCCGTCTCATCAAGGTCAACGACTCCATCCAGCTCGACATCGCCACCTGC AAGATCATGGACATCATCAAGTTCGACTCAGGTAACCTGTGCATGATCACGGGAG GGCGTAACTTGGGCGAGTGGGCACCATCGTGTCCCGCGAGAGGCACCCCGGG AGCTTCGACATCGTCCACATCAAGGACACCACCGGACACACCTTCGCCACCAGGT TGAACAACGTGTTCATCATCGGCAAG |
| PX009 | SEQ ID NO: 2345 GCGTAATACGACTC ACTATAGGCAGCTA CAAGTATTGGGAGA ACCAG | SEQ ID NO: 2346 TGTTGATCACTATGC CGGTCCT SEQ ID NO: 2348 GCGTAATACGACTC ACTATAGGTGTTGAT CACTATGCCGGTCC T | SEQ ID NO: 2344 CAGCTACAAGTATTGGGAGAACCAGTCATTGACTTTTTGTCAGTATACAAGAAGA AGGGTACAGACGGGGTGCTGGTCAGAACATCTTCAACTGTGACTTCCGCAACC CGCCCCACACGCAAGGTGTGCGACGTGGACATCCGCGGCTGGGAGCCCTGC ATTGATGAGAACCACTTCTCTTTCCACAAGTCTTCGCCTTGCATCTTCTTGAAGCT GAATAAGATCTACGGCTGGCGTCCAGAGTTCTACAACGACACGGCTAACCTGCCT GAAGCCATGCCCGTGGACTTGCAGACCCACATTCGTAACATTACTGCCTTCAACA GAGACTATGCGAACATGGTGTGGGTGTCGTGCCACGGCGAGACGCCGGCGAC AAGGAGAACATCGGGCCGGTGCGCTACCTGCCCTACCCGGGCTTCCCGGGTAC TTCTACCCGTACGAGAACGCCGAGGGGTATCTGAGCCCGCTGGTCGCCGTGCAT TTGGAGAGGCCGAGGACCGGCATAGTGATCAACA |
| PX010 | SEQ ID NO: 2350 GCGTAATACGACTC ACTATAGGACCAGC ACTCTAGTGGACAA | SEQ ID NO: 2351 CTGTATCAATGTACC GCGGCAC SEQ ID NO: 2353 | SEQ ID NO: 2349 ACCAGCACTCTAGTGGACAACGTCGCGTTCGGGTCACCACTGTCGCGCGCAATT GGGGCGACGCAGCCGCCAACTTACACCACATATCGGCGGGCTTCGACCAGGAG GCGGCGGCGGTGGTGATGGCGCGGCTGGTGGTGTACCGCGCGGAGCAGGAGG |

TABLE 8-PX-continued

| Target ID | Primers Forward 5' → 3' | Primers Reverse 5' → 3' | dsRNA DNA Sequence (sense strand) 5' → 3' |
|---|---|---|---|
| | CGTC<br>SEQ ID NO: 2352<br>ACCAGCACTCTAGT<br>GGACAACGTC | GCGTAATACGACTC<br>ACTATAGGCTGTATC<br>AATGTACCGCGGCA<br>C | ACGGGCCCGACGTGCTGCGCTGGCTCGACCGCATGCTCATACGCCTGTGCCAGA<br>AGTTCGGCGAGTACGCGAAGGACGACCCGAACAGCTTCCGTCTGTCGGAGAACT<br>TCAGCCTGTACCCGCAGTTCATGTACCACCTGCGCCGCTCGCAGTTCCTGCAGGT<br>CTTCAACAACTCGCCCGACGAGACCACCTTCTACAGACACATGCTGATGCGCAA<br>GACCCTGACCCAATCCCTCATCATGATCCAGCCGATCCTCTACTCGTACAGCTTCG<br>GAGGCGCGCCCGAACCCGTGCTGTTAGACACCAGGTCCTCCATCCAGCCCGACCGA<br>TCCTGCTCATGGACACCTTCTTCCAGATCCTCATCTACCATGGAGAGACAATGGC<br>GCAATGGCGCGCTCTCCGCTACCAAGACATGGCTGAGTACGAGAACTTCAAGCA<br>GCTGCTGCAGCGCCCGTGGACGACGCGCAGGAGATCCTGCAGACCAGGTTCC<br>CCGTGCCGCGGTACATTGATACAG |
| PX015 | SEQ ID NO: 2355<br>GCGTAATACGACTC<br>ACTATAGGGACGAG<br>AAGATCCGCATGAA<br>CC<br>SEQ ID NO: 2357<br>GACGAGAAGATCCG<br>CATGAACC | SEQ ID NO: 2356<br>GATGATGGCCGGAG<br>AGTTCTTG<br>SEQ ID NO: 2358<br>GCGTAATACGACTC<br>ACTATAGGGATGAT<br>GGCCGGAGAGTTCT<br>TG | SEQ ID NO: 2354<br>GACGAGAAGATCCGCATGAACCGCGTCGTCCGGAACAACCTGCGAGTGCGCCTG<br>TCAGACATTGTGTCCATCGCTCCTTGCCCGTCAGTGAAGTACGGCAAGAGAGTTC<br>ATATTCTGCCCATTGATGACTCTGTTGAGGGTTTGACTGGAAACCTGTTCGAAGTC<br>TACCTGAAGCCGTACTTCATGGAGGCGTACCGGCCCATCCACCGCGACGACACG<br>TTCATGGTGCGCGGCGGCATGCGCGCCGTCGAGTTCAAGGTGGTGGAGACCGA<br>CCCCTCGCTCGTGCATCGTGGCCCCCGACACGGTCATTCATTGTGAGGGAGA<br>GCCGATTAAACGCGAGGAAGAAGAGGAGGCTCTCAACGCCGTCGGCTACGACGA<br>CATCGGCGGGTGCCGCAAGCAGCTGGCGCAGATCAAGGAGATGGTGGAGCTGC<br>CGCTGCGCCACCCCTCGCTGTTCAAGGCCATCGGGGTCAAGCCGCCGCGGGGG<br>ATACTGATGTACGGGCCCCCGGGGACGGGGGAAGACCTTGATCGCTAGGGCTGTC<br>GCTAATGAGACGGGCGCATTCTTCTTCCTCATCAACGGCCCCGAGATCATGTCGA<br>AACTCGCCGGTGAATCCGAGTCGAACCTGCGCAAGGCGTTCGAGGAGGCGGACA<br>AGAACTCTCCGGCCATCATC |
| PX016 | SEQ ID NO: 2360<br>GCGTAATACGACTC<br>ACTATAGGCTGGGT<br>CGTATTTTCAACGG<br>CTC<br>SEQ ID NO: 2362<br>CTGGGTCGTATTTTC<br>AACGGCTC | SEQ ID NO: 2361<br>AGTGATGTACCCGG<br>TCAAGTCG<br>SEQ ID NO: 2363<br>GCGTAATACGACTC<br>ACTATAGGAGTGAT<br>GTACCCGGTCAAGT<br>CG | SEQ ID NO: 2359<br>CTGGGTCGTATTTTCAACGGCTCCGGCAAGCCCATCGACAAGGGGCCCCCGATC<br>CTGGCCGAGGAGTACCTGGACATCCAGGGGCAGCCCATCAACCCGTGGTCCCGT<br>ATCTACCCGGAGGAGATGATCCAGACTGGTATCTCCGCTATCGACGTGATGAACT<br>CCATCGCCCGTGGTCAGAAGATCCCCATCTTCTCCGCCGCCGGTCTGCCCCACA<br>ACGAGATTGCTGCTCAGATCTGTAGGCAGGCTGGTCTTGTCAAGGTCCCCGGAAA<br>ATCCGTGTTGGACGACCACGAAGACAACTTCGCCATCGTGTTCGCCGCCATGGG<br>AGTCAACATGGAGACCGCCAGGTTCTTCAAGCAGGACTTCGAGGAGAACGGTTC<br>CATGGAGAACGTCTGTCTGTTCTTGAACTTGGCCAATGACCCGACCATTGAGAGG<br>ATTATCACGCCGAGGTTGGCGCTGACTGCTGCCGAGTTCTTGGCCTACCAGTGC<br>GAGAAACACGTGTTGGTAATCTTGACCGACATGTCTTCATACGCGGAGGCTCTTC<br>GTGAAGTGTCAGCCGCCCGTGAGGAGGTGCCCGGACGACGTGGTTTCCCAGGTT<br>ACATGTACACGGATTTGGCCACAATCTACGAGCGCGCCGGGCGAGTCGAGGGCC<br>GCAACGGCTCCATCACGCAGATCCCCATCCTGACCATGCCCAACGACGACATCA<br>CCCACCCCATCCCCGACTTGACCGGGTACATCACT |

TABLE 8-AD

| Target ID | Primers Forward 5' → 3' | Primers Reverse 5' → 3' | dsRNA DNA Sequence (sense strand) 5' → 3' |
|---|---|---|---|
| AD001 | SEQ ID NO: 2462<br>GCGTAATACGACTC<br>ACTATAGGGCTCCT<br>AAAGCATGGATGTT<br>GG<br>SEQ ID NO: 2464<br>GCTCCTAAAGCATG<br>GATGTTGG | SEQ ID NO: 2463<br>CAATATCAAACGAG<br>CCTGGGTG<br>SEQ ID NO: 2465<br>GCGTAATACGACTC<br>ACTATAGGCAATATC<br>AAACGAGCCTGGGT<br>G | SEQ ID NO: 2461<br>GCTCCTAAAGCATGGATGTTGGACAAACTCGGAGGAGTATTCGCTCCTCGCCCCAG<br>TACTGGCCCCCACAAATTGCGTGAATGTTTACCTTTGGTGATTTTTCTTCGCAATCG<br>GCTCAAGTATGCTCTGACGAACTGTGAAGTAACGAAGATTGTTATGCAGCGACTTAT<br>CAAAGTTGACGGCAAGGTGCGAACCGATCCGAATTATCCCGCTGGTTTCATGGATG<br>TTGTCACCATTGAGAAGACTGGAGAGTTCTTCAGGCTGGTGTATGATGTGAAAGGC<br>CGTTTCACAATTCACAGAATTAGTGCAGAGAAGCCAAGTACAAGTCTGCAAGGTC<br>AGGAGAGTTCAAACTGGGCCAAAAGGTATTCCATTCTTGGTGACCCATGATGGCCG<br>TACTATCCGTTATCCTGACCCAGTCATTAAAGTTAATGACTCAATCCAATTGGATATT<br>GCCACTTGTAAAATCATGGACCACATCAGATTTGAATCGGCAACCTGTGTATGATT<br>ACTGGTGGACGTAACTTGGGTCGAGTGGGGACTGTTGTGAGTCGAGAACGTCACC<br>CAGGCTCGTTTGATATTG |
| AD002 | SEQ ID NO: 2467<br>GCGTAATACGACTC<br>ACTATAGGGAAGAA<br>AGATGGAAAGGCTC<br>CGAC<br>SEQ ID NO: 2469<br>GAAGAAAGATGGAA<br>AGGCTCCGAC | SEQ ID NO: 2468<br>CATCCATGTGCTGA<br>TGAGCTGC<br>SEQ ID NO: 2470<br>GCGTAATACGACTC<br>ACTATAGGCATCCAT<br>GTGCTGATGAGCTG<br>C | SEQ ID NO: 2466<br>GAAGAAAGATGGAAAGGCTCCGACCACTGGTGAGGCCATTCAGAAACTCAGAAAA<br>CAGAAGAAATGTTAATCAAAAAGCAGGAATTTTTAGAGAAGAAATCGAACAAGAAA<br>TCAATGTTGCAAAGAAAATGGAACGAAAAATAAGCGAGCTGCTATTCAGGCTCTGA<br>AAAGGAAAAAGAGGTATGAAAACAATTGCAGCAAATTGATGGCACCTTATCCACAA<br>TTGAAATGCAAAGAAGCTTTGGAGGGTGCTAATACTAATACAGCTGTATTACAAA<br>CAATGAAATCAGCAGCAGATGCCCTTAAAGCAGCTCATCAGCACATGGATG |
| AD009 | SEQ ID NO: 2472<br>GCGTAATACGACTC<br>ACTATAGGGTCTTCT<br>TCCAGACACTGGAT<br>CCTC | SEQ ID NO: 2473<br>CGTGTTCATCTCCCT<br>CGAGTTG<br>SEQ ID NO: 2475<br>GCGTAATACGACTC | SEQ ID NO: 2471<br>GTCTTCTTCCAGACACTGGATCCTCGTATTCCCACCTGGCAGTTAGATTCTTCTATC<br>ATTGGCACATCACCTGGCCTAGGTTTCCGGCCAATGCCAGAAGATAGCAATGTAGA<br>GTCAACTCTCATCTGGTACCGTGGAACAGATCGTGATGACTTCCGTCAGTGGACAG<br>ACACCCTTGATGAATTTCTTGCTGTGTACAAGACTCCTGGTCTGACCCCTGGTCGAG |

TABLE 8-AD-continued

| Target ID | Primers Forward 5' → 3' | Primers Reverse 5' → 3' | dsRNA DNA Sequence (sense strand) 5' → 3' |
|---|---|---|---|
| | SEQ ID NO: 2474 GTCTTCTTCCAGACA CTGGATCCTC | ACTATAGGCGTGTT CATCTCCCTCGAGT TG | GTCAGAACATCCACAACTGTGACTATGATAAGCCGCCAAAGAAAGGCCAAGTTTGC AATGTGGACATCAAGAATTGGCATCCCTGCATTCAAGAGAATCACTACAACTACCAC AAGAGCTCTCCATGCATATTCATCAAGCTCAACAAGATCTACAATTGGATCCCTGAA TACTACAATGAGAGTACGAATTTGCCTGAGCAGATGCCAGAAGACCTGAAGCAGTA CATCCACAACCTGGAGAGTAACAACTCGAGGGAGATGAACACG |
| AD015 | SEQ ID NO: 2477 GCGTAATACGACTC ACTATAGGGTTGAA GGACTAACCGGGAA TTTG SEQ ID NO: 2479 GTTGAAGGACTAAC CGGGAATTTG | SEQ ID NO: 2478 AGAATTTCAAGGCG ACCAGTGG SEQ ID NO: 2480 GCGTAATACGACTC ACTATAGGAGAATTT CAAGGCGACCAGTG G | SEQ ID NO: 2476 GTTGAAGGACTAACCGGGAATTTGTTTGAGGTGTACTTAAAACCGTACTTTCTCGAA GCATACCGACCCATTCACAAAGATGATGCGTTTATTGTTCGTGGTGGTATGCGAGCA GTAGAATTCAAAGTAGTGGAAACAGATCCTTCACCATATTGTATTGTTGCTCCTGATA CTGTTATTCACTGTGAAGGTGATCCAATAAAACGTGAAGAGGAAGAAGAAGCATTAA ATGCTGTTGGTTATGATGACATTGGGGGTTGCCGAAAACAGCTAGCACAGATCAAG GAAATGGTGGAATTGCCATTACGGCACCCCAGTCTCTTTAAGGCTATTGGTGTTAAG CCACCGAGGGGAATACTGCTGTATGGACCCCGTGGAACTGGTAAAACCCTCATTGC CAGGGCTGTGGCTAATGAAACTGGTGCATTCTTCTTTTTAATAAATGGTCCTGAAATT ATGAGCAAGCTTGCTGGTGAATCTGAAAGCAACTTACGTAAGGCATTTGAAGAAGCT GATAAGAATGCTCCGGCAATTATATTTATTGATGAACTAGATGCAATTGCCCCTAAAA GAGAAAAAACTCATGGAGAGGTGGAACGTCGCATAGTTTCACAACTACTAACTTTAA TGGATGGTCTGAAGCAAAGTTCACATGTTATTGTTATGGCTGCCACAAATAGACCCA ACTCTATTGATGGTGCCTTGCGCCGCTTTGGCAGATTTGATAGGGAAATTGATATTG GTATACCAGATGCCACTGGTCGCCTTGAAATTCT |
| AD016 | SEQ ID NO: 2482 GCGTAATACGACTC ACTATAGGACCCGG AAGAAATGATCCAG AC SEQ ID NO: 2484 ACCCGGAAGAAATG ATCCAGAC | SEQ ID NO: 2483 ATGTAGCCTGGGAA GCCTCTTC SEQ ID NO: 2485 GCGTAATACGACTC ACTATAGGATGTAG CCTGGGAAGCCTCT TC | SEQ ID NO: 2481 ACCCGGAAGAAATGATCCAGACGGGGATCTCGACCATCGACGTGATGACGTCCATC GCGCGAGGGCAGAAGATCCCCATCTTCTCGGGCGCAGGGCTGCCACACAACGAGA TCGCTGCGCAGATCTGCCGACAGGCGGGGCTGGTGCAGCACAAGGAGAACAAGGA CGACTTCGCCATCGTGTTCGCGGCGATGGGCGTCAACATGGAGACGGCGCGCTTC TTCAAGCGCGAGTTCGCGCAGACGGGCGCGTGCAACGTGGTGCTGTTCCTCAACC TGGCCAACGACCCCACCATCGAGCGCATCATCACCCCGCGCCTCGCGCTCACCGT GGCCGAGTTCCTGGCCTACCAGTGCAACAAGCACGTGCTCGTCATCATGACCGACA TGACCTCCTACGCGGAGGCGCTGCGCGAGGTGAGCGCGGCGCGCGAGGAGGTTC CTGGGCGAAGAGGCTTCCCAGGCTACAT |

TABLE 9-LD

| Target ID | Hairpin Sequence 5' → 3' |
|---|---|
| LD002 | SEQIDNO: 240 GCCCTTGCAATGTCATCCATCATGTCGTGTACATTGTCCACGTCCAAGTTTTTATGGGCTTTCTTAAGAGCTTCAGCTGCATTTTTCAT AGATTCCAATACTGTGGTGTTCGTACTAGCTCCCTCCAGAGCTTCTCGTTGAAGTTCAATAGTAGTTAAAGTGCCATCTATTTGCAACT GATTTTTTTCTAATCGCTTCTTCCGCTTCAGCGCTTGCATGGCCGCTCAAGGGCGAATTCACCAGCTTTCTTGTACAAAGTGGTATATC ACTAGTGCGGCCGCCTGCAGGTCGACCATATGGTCGACCTGCAGGCGGCCGCACTAGTGATGCTGTTATGTTCAGTGTCAAGCTGA CCTGCAAACACGTTAAATGCTAAGAAGTTAGAATATATGAGACACGTTAACTGGTATATGAATAAGCTGTAAATAACCGAGTATAAACT CATTAACTAATATCACCTCTAGAGTATAATATAATCAAATTCGACAATTTGACTTTCAAGAGTAGGCTAATGTAAAATCTTTATATATTTC TACAATGTTCAAAGAAACAGTTGCATCTAAACCCCTATGGCCATCAAATTCAATGAACGCTAAGCTGATCCGGCGAGATTTTCAGGAG CTAAGGAAGCTAAAATGGAGAAAAAAATCACTGGATATACCACCGTTGATATATCCCAATGGCATCGTAAAGAACATTTTGAGGCATTT CAGTCAGTTGCTCAATGTACCTATAACCAGACCGTTCAGCTGGATATTACGGCCTTTTTAAAGACCGTAAAGAAAAATAAGCACAAGTT TTATCCGGCCTTTATTCACATTCTTGCCCGCCTGATGAATGCTCATCCGGAATTCCGTATGGCAATGAAAGACGGTGAGCTGGTGATA TGGGATAGTGTTCACCCTTGTTACACCGTTTTCCATGAGCAAACTGAAACGTTTTCATCGCTCTGGAGTGAATACCACGACGATTTCC GGCAGTTTCTACACATATATTCGCAAGATGTGGCGTGTTACGGTGAAAACCTGGCCTATTTCCCTAAAGGGTTTATTGAGAATATGTTT TTCGTCTCAGCCAATCCCTGGGTGAGTTTCACCAGTTTTGATTTAAACGTGGCCAATATGGACAACTTCTTCGCCCCCGTTTTCACCAT GGGCAAATATTATACGCAAGGCGACAAGGTGCTGATGCCGCTGGCGATTCAGGTTCATCATGCCGTCTGTGATGGCTTCCATGTCGG CAGAATGCTTAATGAATTACAACAGTACTGCGATGAGTGGCAGGGCGGGGCGTAAACGCGTGGATCAGCTTAATATGACTCTCAATA AGTCTCATACCAACAAGTGCCACCTTATTCAACCATCAAGAAAAAGCCAAATTTATGTACTCTAAGGAAAACTTCACTAAGAAG ACGATTTAGAGTGTTTTACCAAGAATTTCTGTCATCTTACTAAACAACTAAAGATCGGTGTGATACAAAACCTAATCTCATTAAAGTTTA TGCTAAAATAAGCATAATTTACCCACTAAGCGTGACCAGATAAACTCAGCACACCAGAACATATATTTGGTGGCTCAAATCA TAGAAACTTACAGTGAAGACACAGAAAGCGTGAAGAAGAGGCAAGAGTATGAAACCTTACCTCATCATTTCCATGAGGTTGCTTCTGA TCCCGCGGGATATCACCACTTTGTACAAGAAAGCTGGGTCGAATTCGCCCTTGAGCGGCCATGCAAGCGCTGAAGCGGAAGAAGCG ATTAGAAAAAATCAGTTGCAAATAGATGGCACTTTAACTACTATTGAACTTCAACGAGAAGCTCTGGAGGGAGCTAGTACGAACACC ACAGTATTGGAATCTATGAAAATGCAGCTGAAGCTCTTAAGAAAGCCCATAAAAACTTGGACGTGGACAATGTACACGACATGATGG ATGACATTGCAAGGGC |
| LD006 | SEQIDNO: 241 GCCCTTGGAGCGAGACTACAACAACTATGGCTGGCAGGTGTTGGTTGCTTCTGGTGTGGTGGAATACATCGACACTCTTGAAGAAGA AACTGTCATGATTGCGATGAATCCTGAGGATCTTCGGCAGGACAAAGAATATGCTTATTGTACGACCTACACCCACTGCGAAATCCAC CCGGCCATGATCTTGGGCGTTTGCGCGTCTATTATACCTTTCCCCGATCATAACCAGAGCCCAAGGAACACCTACCAGAGCGCTATG GGTAAGCAAGCTATGGGGGTCTACATTACGAATTTCCACGTGCGGATGGACACCCTGGCCCACGTGCTATACTACCCGCACAAACCT CTGGTCACTACCAGGTCTATGGAGTATCTGCGGTTCAGAGAATTACAGCCGGGAATCAACAGTATAGTTGCTATTGTTGTTATACTG GTTATAATCAAGAGAATTCTGTTATTCGTAACGCGTCTGCTGTGGAAAGAGGATTTTTCCGATCCGTGTTTTATCGTTCCTATAAAGAT GCCGAATCGAAGCGAATTGGCGATCAAGAAGAGCAGTTCGAGAAGGGCGAATTCACCAGCTTTCTTGTACAAAGTGGTATATCACTA GTGCGGCCGCCTGCAGGTCGACCATATGGTCGACCTGCAGGCGGCCGCACTAGTGATGCTGTTATGTTCAGTGTCAAGCTGACCTG CAAACACGTTAAATGCTAAGAAGTTAGAATATATGAGACACGTTAACTGGTATATGAATAAGCTGTAAATAACCGAGTATAAACTCATT AACTAATATCACCTCTAGAGTATAATATAATCAAATTCGACAATTTGACTTTCAAGAGTAGGCTAATGTAAAATCTTTATATATTTCTACA |

TABLE 9-LD-continued

| Target ID | Hairpin Sequence 5' → 3' |
|---|---|
| | ATGTTCAAAGAAACAGTTGCATCTAAACCCCTATGGCCATCAAATTCAATGAACGCTAAGCTGATCCGGCGAGATTTTCAGGAGCTAA<br>GGAAGCTAAAATGGAGAAAAAAATCACTGGATATACCACCGTTGATATATCCCAATGGCATCGTAAAGAACATTTTGAGGCATTTCAGT<br>CAGTTGCTCAATGTACCTATAACCAGACCGTTCAGCTGGATATTACGGCCTTTTTAAAGACCGTAAAGAAAAATAAGCACAAGTTTTAT<br>CCGGCCTTTATTCACATTCTTGCCCGCCTGATGAATGCTCATCCGGAATTCCGTATGGCAATGAAAGACGGTGAGCTGGTGATATGG<br>GATAGTGTTCACCCTTGTTACACCGTTTTCCATGAGCAAACTGAAACGTTTTCATCGCTCTGGAGTGAATACCACGACGATTTCCGGC<br>AGTTTCTACACATATATTCGCAAGATGTGGCGTGTTACGGTGAAAACCTGGCCTATTTCCCTAAAGGGTTTATTGAGAATATGTTTTTC<br>GTCTCAGCCAATCCCTGGGTGAGTTTCACCAGTTTTGATTTAAACGTGGCCAATATGGACAACTTCTTCGCCCCCGTTTTCACCATGG<br>GCAAATATTATACGCAAGGCGACAAGGTGCTGATGCCGCTGGCGATTCAGGTTCATCATGCCGTCTGTGATGGCTTCCATGTCGGCA<br>GAATGCTTAATGAATTACAACAGTACTGCGATGAGTGGCAGGGCGGGGCGTAAACGCGTGGATCAGCTTAATATGACTCTCAATAAA<br>GTCTCATACCAACAAGTGCCACCTTATTCAACCATCAAGAAAAAAGCCAAAATTTATGCTACTCTAAGGAAAACTTCACTAAAGAAGAC<br>GATTTAGAGTGTTTTACCAAGAATTTCTGTCATCTTACTAAACAACTAAAGATCGGTGTGATACAAAACCTAATCTCATTAAAGTTTATG<br>CTAAAATAAGCATAATTTTACCCACTAAGCGTGACCAGATAAACATAACTCAGCACACCAGAGCATATATATTGGTGGCTCAAATCATA<br>GAAACTTACAGTGAAGACACAGAAAGCCGTAAGAAGAGGCAAGAGTATGAAACCTTACCTCATCATTTCCATGAGGTTGCTTCTGATC<br>CCGCGGATATCACCACTTTGTACAAGAAAGCTGGGTCGGCCCTTCTCGAACTGCTCTTCTTGATCGCCAATTCGCTTCGATTCGGC<br>ATCTTTATAGGAACGATAAAACACGGATCGGAAAAATCCTCTTTCCACAGCAGACGCGTTCAGAATAACAGAATCTTCTTGATTATAAC<br>CAGTATAACAAGCAATAGCAACTATACTGTTGATCCCGGCTGGTAATTCTCTGAACGCAGATACTCCATAGACCTGGTAGTGACCAG<br>AGGTTTGTGCGGGTAGTATAGCACGTGGGCCAGGGTGTCCATCCGCACGTGGAAATTCGTAATGTAGACCCCCATAGCTTGCTTACC<br>CATAGCGCTCTGGTAGGTGTTCCTTGGGCTCTGGTTATGATGGGGAAAGGTATAATAGACGCGCAAACGCCCAAGATCATGGCCG<br>GGTGGATTTCGCAGTGGGTGTAGGTCGTACAATAAGCATATTCTTTTGTCCTGCCGAAGATCCTCAGGATTCATCGCAATCATGACAGT<br>TTCTTCTTCAAGAGTGTCGATGTATTCCACCACACCAGAAGCAACCAACCACCTGCCAGCCAGTTGTTGTAGTCTCGCTCCAAGGGC |
| LD007 | SEQIDNO: 242<br>GCCCTTCCGAAGAAGGATGTGAAGGGTACTTACGTATCCATACACAGTTCAGGCTTCAGAGATTTTTTATTGAAACCAGAAATTCTAA<br>GAGCTATAGTTGACTGCGGTTTTGAACACCCTTCAGAAGTTCAGCACGAATGTATTCCTCAAGCTGTCATTGGCATGGACATTTTATGT<br>CAAGCCAAATCTGGTATGGGCAAAACGGCAGTGTTTGTTCTGGCGACACTGCAACAATTGGAACCAGCGGACAATGTTGTTTACGTTT<br>TGGTGATGTGTCACACTCGTGAACTGGCTTTCCAAATCAGCAAAGAGTACGAGAGGTTCAGTAAATATATGCCCAGTGTCAAGGTGG<br>GCGTCTTTTTCGGAGGAATGCCTATTGCTAACGATGAAGAAGTATTGAAAAACAAATGTCCACACATTGTTGTGGGGACGCCTGGGC<br>GTATTTTGGCGCTTGTCAAGTCTAGGAAGCTAGTCCTCAAGAACCTGAAACACTTCATTCTTGATGAGTGCGATAAAATGTTAGAACTG<br>TTGGATATGAGGAGAGACGTCCAGGAAATCTACAGAAACACCCCTCACACCAAGCAAGTGATGATGTTCAGTGCCACACTCAGCAAA<br>GAAATCAGGCCGGTGTGCAAGAAATTCATGCAAGATCCAATGGAGGTGTATGTAGACGATGAAGCCAAATTGACGTTGCACGGATTA<br>CAACAGCATTACGTTAAACTCAAAGAAAATGAAAAGAATAAAAAATTATTTGAGTTGCTCGATGTTCTCGAATTTAATCAGGTGGTCATT<br>TTTGTGAAGTCCGTTCAAAGGTGTGTGGCTTTGGCACAGTTGCTGACTGAACAGAATTTCCCAGCCATAGGAATTCACAGAGGAATG<br>GACCAGAAAGAGAGGTTGTCTCGGTATGAGCAGTTCAAAGATTTCCAGAAGAGAATATTGGTAGCTACGAATCTCTTTGGGCGTGGC<br>ATGGACATTGAAAGGGTCAACATTGTCTTCAACTATGATATGCCAGAGGACTCCGACACCTACTTGCATCGAAGGGCGAATTCACCAG<br>CTTTCTTGTACAAAGTGGTATATCACTAGTGCGGCCGCCTGCAGGTCGACCATATGGTCGACCTGCAGGCGGCCGCACTAGTGATGC<br>TGTTATGTTCAGTGTCAAGCTGACCTGCAAACACGTTAAATGCTAAGAAGTTAGAATATATGAGACGCGTTAACTGGTATATGAATAAG<br>CTGTAAATAACCGAGTATAAACTCATTAACTAATATCACCTCTAGAGTATAATATAATCAAATTCGACAATTTGACTTTCAAGAGTAGGC<br>TAATGTAAAATCTTTATATATTTCTACAATGTTCAAAGAAACAGTTGCATCTAAACCCCTATGGCCATCAAATTCAATGAACGCTAAGCT<br>GATCCGGCGAGATTTTCAGGAGCTAAGGAAGCTAAAATGGAGAAAAAAATCACTGGATATACCACCGTTGATATATCCCAATGGCATC<br>GTAAAGAACATTTTGAGGCATTTCAGTCAGTTGCTCAATGTACCTATAACCAGACCGTTCAGCTGGATATTACGGCCTTTTTAAAGACC<br>GTAAAGAAAAATAAGCACAAGTTTTATCCGGCCTTTATTCACATTCTTGCCCGCCTGATGAATGCTCATCCGGAATTCCGTATGGCAAT<br>GAAAGACGGTGAGCTGGTGATATGGGATAGTGTTCACCCTTGTTACACCGTTTTCCATGAGCAAACTGAAACGTTTTCATCGCTCTGG<br>AGTGAATACCACGACGATTTCCGGCAGTTTCTACACATATATTCGCAAGATGTGGCGTGTTACGGTGAAAACCTGGCCTATTTCCCTA<br>AAGGGTTTATTGAGAATATGTTTTTCGTCTCAGCCAATCCCTGGGTGAGTTTCACCAGTTTTGATTTAAACGTGGCCAATATGGACAAC<br>TTCTTCGCCCCCGTTTTCACCATGGGCAAATATTATACGCAAGGCGACAAGGTGCTGATGCCGCTGGCGATTCAGGTTCATCATGCC<br>GTCTGTGATGGCTTCCATGTCGGCAGAATGCTTAATGAATTACAACAGTACTGCGATGAGTGGCAGGGCGGGGCGTAAACGCGTGG<br>ATCAGCTTAATATGACTCTCAATAAAGTCTCATACCAACAAGTGCCACCTTATTCAACCATCAAGAAAAAAGCCAAAATTTATGCTACTC<br>TAAGGAAAACTTCACTAAAGAAGACGATTTAGAGTGTTTTACCAAGAATTTCTGTCATCTTACTAAACAACTAAAGATCGGTGTGATAC<br>AAAACCTAATCTCATTAAAGTTTATGCTAAAATAAGCATAATTTTACCCACTAAGCGTGACCAGATAAACATAACTCAGCACACCAGAG<br>CATATATATTGGTGGCTCAAATCATAGAAACTTACAGTGAAGACACAGAAAGCCGTAAGAAGAGGCAAGAGTATGAAACCTTACCTCA<br>TCATTTCCATGAGGTTGCTTCTGATCCGCGGGATATCACCACTTTGTACAAGAAAGCTGACCCTTGTACAAGAAAAGCAGGCTGGATGCAAGTA<br>GGTGTCGGAGTCCTCTGGCATATCATAGTTGAAGACAATGTTGACCCTTTCAATGTCCATGCCACGCCCAAAGAGATTCGTAGCTACC<br>AATATTCTTCTGGGAAATCTTTGAACTGCTCATACCGAGACAACCTCTCTTTCTGGTCCATTCCTCTGTGAATTCCTATGGCTGGGAA<br>ATTCTGTTCAGTCAGCAACTGTGCCAAAGCCACACACCTTTGAACGGACTTCACAAAAATGACCACCTGATTAAATTCGAGAACATCG<br>AGCAACTCAAATAATTTTTATTCTTTTCATTTTCTTTGAGTTTAACGTAATGCTGTTGTAATCCGTGCAACGTCAATTTGGCTTCATCGT<br>CTACATACACCTCCATTGGATCTTGCATGAATTTCTTGCACACCGGCCTGATTTCTTTGCTGAGTGTGGCACTGAACATCATCACTTGC<br>TTGGTGTGAGGGGTGTTTCTGTAGATTTCCTGGACGTCTCTCCTCATATCCAACAGTTCTAACATTTTATCGCACTCATCAAGAATGAA<br>GTGTTTCAGGTTCTTGAGGACTAGCTTCCTAGACTTGACAAGCGCCAAAATACGCCCAGGCGTCCCCACAACAATGTGTGGACATTT<br>GTTTTTCAATACTTCTTCATCGTTAGCAATAGGCATTCCTCCGAAAAAGACGCCCACCTTGACACTGGGCATATATTTACTGAACCTCT<br>CGTACTCTTTGCTGATTTGGAAAGCCAGTTCACGAGTGTGACACATCACCAAAACGTAAACAACATTGTCCGCTGGTTCCAATTGTTG<br>CAGTGTCGCCAGAACAAACACTGCCGTTTTGCCCATACCAGATTTGGCTTGACATAAAATGTCCATGCCAATGACAGCTTGAGGAATA<br>CATTCGTGCTGAACTTCTGAAGGGTGTTCAAAACCGCAGTCAACTATAGCTCTTAGAATTTCTGGTTTCAATAAAAATCTCTGAAGCC<br>TGAACTGTGTATGGATACGTAAGTACCCTTCACATCCTTCTTCGGAAGGGC |
| LD010 | SEQIDNO: 243<br>GCCCTTCGCCATTGGGCGATGGTTTCGCCATGGAATATCAGAATCTGGAAGAACGTGTCCATGAGCAGAATTCTATCGGGTTGGATG<br>GAACTCGTATCCAAAAGCACAGGTTCTGGTGGTCCATTGAAACTGTAGCTGTAGAGTATCGGCTGGATCATGATCAGCGACTGCGTG<br>AGGTCTTCGCGCATAAGCATGTGCCTGTAGAAGGACGTTTCGTCGGGAGAATTGTTAAACACCTGCAGGAACTGTGACCTTCTCAAA<br>TGGTACATGAACTGCGGGTAGAGGCTGAAGTTTTCGCCCAAGCGGAACGAATTCGGGTCGTTCCTTGTTATATTCGCCGAATTTCTGG<br>CACAGACGTATCAACATCCTATCGACCCATCTCAAACATCAGGGCTATCGTCTGATTCCGCTCTGTAAACTGCCATCCTCGCCATTA<br>TCACTGCGGCTGCCTCCTGATCGAATCCAGCACTGACATGATGTATATTAGCGGAAGCATCGGCCCAGTTTCTAGCAACTGTCGTTA<br>CTCGGATCCTCTTGGCCACTAGCTGCTAGTATTGCGTGATTGCGTGATACTGAGCCCCTTCCCCCTTGAGGTATGGGAGCGGAAT<br>GTTGGTTGACGACCTCGAAGAACAAGGCCATGGTAGTACTTGGAGTTACCGTACACATTTTGCACTGGACGTGTTACCCATTCCTAT<br>TTCGGTGTCGGAAACCAAAGGATTCTTCACATTCAACGAAACACAAGATCCAATACCGCCTTGAATTTTCAACTCCCTGGAACACTTG<br>ACCCTCCAGAGTACCATTAAATGCCATCTTCAGCTCGTTTTTCTGATCTTTCGAAAATATGCGCTGGAACGTTTGCTTGAACAGGGAA<br>GAATTGAACGAGTCGCCCATGACCATATGTCCCCCTGTTGAATTACAACACTGTTTCATCTCCATCAATCCTGTCTGATCCAAAGCGC<br>ATGAATATATGTCAACGCAGTGGCCATTCGTTGCTGCTCTCATCGCTAAATTATCATAGTGCTTGATTGCTTTCTTCATGTATTTGGCAT |

TABLE 9-LD-continued

| Target ID | Hairpin Sequence 5' → 3' |
|---|---|
| | TGTCTTTTTGGATGTCGTGGTGAGATCTGATAGGTTGCTTCAGATCATCATTCAAGACTTGACCAGGGCCTTGAGAGCAAGGTCCTCC<br>AACGAATAGCATGACCCTGGCACCAGTATTGGCGTATGTGCACTCCAACAACCCAATGGCTATCGATAAAGCTGTCCCGGTCGATCT<br>AAGGGCGCATTTGCCTTGGTGGACAGGCCATGGGTCTCTTTGCAACTCTCCAATAAGATCAGTGAGGTTCATGTCGCATTTCGAGAT<br>GGGTTGAAGGAACCTGCTTCCTGGTGGCGTAGGAGCTTGCTGGAGTGCTCCAGGCCTCATGGGTTGTCCTGGTTGTTGAGGAGCAG<br>GTTGAGCACTTACTGCGGCTCTGCCCACTTCCAACATCTCTTGAACTTGCTTAGCTGTGAGGTCTTTCGTCCCTCGGAAAACGTAAGA<br>TTTGCTGCAGCCCTCGGTACCTAGTTCGTGCACTTGGACCATCTTCCCAAAGGTAATCAACCCTATCAAGGCATTCGGGGGCAACAA<br>GCTCAAAGACATCTGCAACGAATCCTTGAGAGAAGGGCGAATTCACCCAGCTTTCTTGTACAAAGTGGTATATCACTAGTGCGGCCGC<br>CTGCAGGTCGACCATATGGTCGACCTGCAGGCGGCCGCACTAGTGATGCTGTTATGTTCAGTGTCAAGCTGACCTGCAAACACGTTA<br>AATGCTAAGAAGTTAGAATATATGAGACACGTTAACTGGTATATGAATAAGCTGTAAATAACCGAGTATAAACTCATTAACTAATATCAC<br>CTCTAGAGTATAATATAATCAAATTCGACAATTTGACTTTCAAGAGTAGGCTAATGTAAAATCTTTATATATTTCTACAATGTTCAAAGAA<br>ACAGTTGCATCTAAACCCCTATGGCCATCAAATTCAATGAACGCTAAGCTGATCCGGCGAGATTTTCAGGAGCTAAGGAAGCTAAAAT<br>GGAGAAAAAAATCACTGGATATACCACCGTTGATATATCCCAATGGCATCGTAAAGAACATTTTGAGGCATTTCAGTCAGTTGCTCAAT<br>GTACCTATAACCAGACCGTTCAGCTGGATATTACGGCCTTTTTAAAGACCGTAAAGAAAAATAAGCACAAGTTTTATCCGGCCTTTATT<br>CACATTCTTGCCCGCCTGATGAATGCTCATCCGGAATTCCGTATGGCAATGAAAGACGGTGAGCTGGTTGGTGATATGGGATAGTGTTCAC<br>CCTTGTTACACCGTTTTCCATGAGCAAACTGAAACGTTTTCATCGCTCTGGAGTGAATACCACGACGATTTCCGGCAGTTTCTACACAT<br>ATATTCGCAAGATGTGGCGTGTTACGGTGAAAACCTGGCCTATTTCCCTAAAGGGTTTATTGAGAATATGTTTTCGTCTCAGCCAATC<br>CCTGGGTGAGTTTCACCAGTTTTGATTTAAACGTGGCCAATATGGACAACTTCTTCGCCCCCGTTTTCACCATGGGCAAATATTATAC<br>GCAAGGCGACAAGGTGCTGATGCCGCTGGCGATTCAGGTTCATCATGCCGTCTGTGATGGCTTCCATGTCGGCAGAATGCTTAATGA<br>ATTACAACAGTACTGCGATGAGTGGCAGGGCGGGGCGTAAACGCGTGGATCAGCTTAATATGACTCTCAATAAAGTCTCATACCAAC<br>AAGTGCCACCTTATTCAACCATCAAGAAAAAAGCCAAAATTTATGCTACTCTAAGGAAAACTTCACTAAAGAAGACGATTTAGAGTGTT<br>TTACCAAGAATTTCTGTCATCTTACTAAACAACTAAAGATCGGTGTGATACAAAACCTAATCTCATTAAAGTTTATGCTAAAATAAGCAT<br>AATTTTACCCACTAAGCGTGACCAGATAAACATAACTCAGCACCAGAGCATATATATTGGTGGCTCAAATCATAGAAACTTACAGTG<br>AAGACACAGAAAGCCGTAAGAAGAGGCAAGAGTATGAAACCTTACCTCATCATTTCCATGAGGTTGCTTCTGATCCCGCGGGATATC<br>GACCACTTTGTACAAGAAAGCTGGTCGAATTCGCCCTTCTCTCAAGGATTCGTTCAGATGTCTTTGAGCTTGTTGCCCCGAATGCC<br>TTGATAGGGTTGATTACCTTTGGGAAGATGGTCCAAGTGCACGAACTAGGTACCGAGGGCTGCAGCAAATCTTACGTTTTCCGAGGG<br>ACGAAAGACCTCACAGCTAAGCAAGTTCAAGAGATGTTGGAAGTGGGCAGAGCCGCAGTAAGTGCTCAACCTGCTCCTCAACAACCA<br>GGACAACCCATGAGGCCTGGAGCACTCCAGCAAGCTCCTACGCCACCAGGAAGCAGGTTCCTTCAACCCATCTCGAAATGCGACAT<br>GAACCTCACTGATCTTATTGGAGAGTTGCAAAGAGACCCATGGCCTGTCCACCAAGGCAAATGCGCCCTTAGATCGACCGGGACAGC<br>TTTATCGATAGCCATTGGGTTGTTGGAGTGCACATACGCCAATACTGGTGCCAGGGTCATGCTATTCGTTGGAGGACCTTGCTCTCAA<br>GGCCCTGGTCAAGTCTTGAATGATGATCTGAAGCAACCTATCAGATCTCACCACGACATCCAAAAAGACAATGCCAAATACATGAAGA<br>AAGCAATCAAGCACTATGATAATTTAGCGATGAGAGCAGCAACGAATGGCCACTGCGTTGACATATATTCATGCGCTTTGGATCAGAC<br>AGGATTGATGGAGATGAAACAGTGTTGTAATTCAACAGGGGGACAATGTCATGGGCGACTCGTTCAATTCTTCCCTGTTCAAGCAA<br>ACGTTCCAGCGCATATTTTCGAAAGATCAGAAAAACGAGCTGAAGATGGCATTTAATGGTACTCTGGAGGGTCAAGTGTTCCAGGGA<br>GTTGAAAATTCAAGGCGGTATTGGATCTTGTGTTTCGTTGAATGTGAAGAATCCTTTGGTTTCCGACACCGAAATAGGAATGGGTAAC<br>ACGGTCCAGTGGAAAATGTGTACGGTAACTCCAAGTACTACCATGGCCTTGTTCTTCGAGGTCGTCAACCAACATTCCGCTCCCATAC<br>CTCAAGGGGAAGGGCTGCATACAGTTCATCACGCAATATCAGCATGCTAGTGGCCAGAAGAGGATCCGAGTAACGACAGTTGCT<br>AGAAACTGGGCCGATGCTTCCGCTAATATACATCATGTCAGTGCTGGATTCGATCAGGAGGCAGCCGCAGTGATAATGGCGAGGATG<br>GCAGTTTACAGAGCGGAATCAGACGATAGCCCTGATGTTTTGAGATGGGTCGATAGGATGTTGATCGTCTGTGCCAGAAATTCGGC<br>GAATATAACAAGGACGACCCGAATTCGTTCCGCTTGGGCGAAAACTTCAGCCTCTACCCGCAGTTCATGTACCATTTGAGAAGGTCA<br>CAGTTCCTGCAGGTGTTTAACAATTCTCCCGACGAAACGTCCTTCTACAGGCACATGCTTATGCGCGAAGACCTCACGCAGTCGCTG<br>ATCATGATCCAGCCGATACTCTACAGCTACAGTTTCAATGGACCACCAGAACCTGTGCTTTTGGATACGAGTTCCATCCAACCCGATA<br>GAATTCTGCTCATGGACACGTTCTTCCAGATTCTGATATTCCATGGCGAAACCATCGCCCAATGGCGAAGGGC |
| LD011 | SEQIDNO: 244<br>GCCCTTGTGGAAGCAGGGCTGGCATGGCGACAAATTCTAGATTGGGATCACCAATAAGCTTCCTAGCTAGCCATAGGAAAGGCTTCT<br>CAAAGTTGTAGTTAGATTTGGCAGAGATATCATAGTACTGCAAATTCTTCTTCCTATGAAAGACAATACTTTTCGCTTTTACTTTTCGT<br>CTTTGATGTCAACCTTGTTCCCGCAAAGTACTATCGGGATATTTTCACAGACTCTGACAAGATCTCTGTGCCAATTTGGTACATTCTTG<br>TATGTAACTCTGGAAGTTACATCAAACATGATAATAGCACACTGTCCTGAATGTAATATCCATCACGGAGCACCAAACTTCTCCTG<br>ACCGGCAGTGTCCCATACATTGAACCGAATAGGGCCCCTGTTTGTATGGAAGACCAGAGGATGGACTTCAACTCCCAAAGTAGCTAC<br>ATATCTTTTTCAAATTCACCAGTCATATGACGTTTCACAAATGTCGTTTTTCCAGTACCTCCATCTCCGACCAACACACACTTGAAAGT<br>GGGAAGGGCGAATTCGACCCAGCTTTCTTGTACAAAGTGGTGATATCACTAGTGCGGCCGCCTGCAGGTCGACCATATGGTCGACC<br>TGCAGGCGGCCGCACTAGTGATGCTGTTATGTTCAGTGTCAAGCTGACCTGCAAACACGTTAAATGCTAAGAAGTTAGAATATATGAG<br>ACACGTTAACTGGTATATGAATAAGCTGTAAATAACCGAGTATAAACTCATTAACTAATATCACCTCTAGAGTATAATATAATCAAATTC<br>GACAATTTGACTTTCAAGAGTAGGCTAATGTAAAATCTTTATATATTTCTACAATGTTCAAAGAAACAGTTGCATCTAAACCCCTATGGC<br>CATCAAATTCAATGAACGCTAAGCTGATCCGGCGAGATTTTCAGGAGCTAAGGAAGCTAAATGGAGAAAAAAATCACTGGATATACC<br>ACCGTTGATATATCCCAATGGCATCGTAAAGAACATTTTGAGGCATTTCAGTCAGTTGCTCAATGTACCTATAACCAGACCGTTCAGCT<br>GGATATTACGGCCTTTTTAAAGACCGTAAAGAAAAATAAGCACAAGTTTTATCCGGCCTTTATTCACATTCTTGCCCGCCTGATGAATG<br>CTCATCCGGAATTCCGTATGGCAATGAAAGACGGTGAGCTGGTTGGTGATATGGGATAGTGTTCACCCTTGTTACACCGTTTTCCATGAGCA<br>AACTGAAACGTTTTCATCGCTCTGGAGTGAATACCACGACGATTTCCGGCAGTTTCTACACATATATTCGCAAGATGTGGCGTGTTAC<br>GGTGAAAACCTGGCCTATTTCCCTAAAGGGTTTATTGAGAATATGTTTTCGTCTCAGCCAATCCCTGGGTGAGTTTCACCAGTTTTGA<br>TTTAAACGTGGCCAATATGGACAACTTCTTCGCCCCCGTTTTCACCATGGGCAAATATTATACGCAAGGCGACAAGGTGCTGATGCCG<br>CTGGCGATTCAGGTTCATCATGCCGTCTGTGATGGCTTCCATGTCGGCAGAATGCTTAATGAATTACAACAGTACTGCGATGAGTGG<br>CAGGGCGGGGCGTAAACGCGTGGATCAGCTTAATATGACTCTCAATAAAGTCTCATACCAACAAGTGCCACCTTATTCAACCATCAAG<br>AAAAAAGCCAAAATTTATGCTACTCTAAGGAAAACTTCACTAAAGAAGACGATTTAGAGTGTTTTACCAAGAATTTCTGTCATCTTACTA<br>AACAACTAAAGATCGGTGTGATACAAAACCTAATCTCATTAAAGTTTATGCTAAAATAAGCATAATTTTACCCACTAAGCGTGACCAGAT<br>AAACATAACTCAGCACACCAGAGCATATATTGGTGGCTCAAATCATAGAAACTTACAGTGAAGACACAGAAAGCCGTAAGAAGAGG<br>CAAGAGTATGAAACCTTACCTCATCATTTCCATGAGGTTGCTTCTGATCCCGCGGGATATCGGACCACTTTGTACAAGAAAGCTGGGT<br>CGAATTCGCCCTTCCCACTTTCAAGTGTGTCTTGGTCGGAGATGGAGGTACTGGAAAAACGACATTTGTGAAACGTCATATGACTGGT<br>GAATTTGAAAAAGATATGTAGCTACTTTGGGAGTTGAAGTCCATCCTCTGGTCTTCCATACAAACAGGGGCCCTATTCGGTTCAATG<br>TATGGGACACTGCCGGTCAGGAGAAGTTTGGTGGTCTCCGTGATGGATATTACATTCAGGGACAGTGTGCTATTATCATGTTTGATGT<br>AACTTCCAGAGTTACATACAAGAATGTACCAATTGGCACAGAGATCTTGTCAGAGTCTGTGAAAATATCCCGATAGTACTTTGCGGG<br>AACAAGGTTGACATCAAAGACAGAAAAGTAAAAGCGAAAGTATTGTCTTTCATAGGAAGAAGAATTTGCAGTACTATGATATCTCTGC<br>CAAATCTAACTACAACTTTGAGAAGCCTTTCCTATGGCTAGCTAGGAAGCTTATTGGTGATCCCAATCTAGAATTTGTCGCCATGCCAG<br>CCCTGCTTCCACAAGGGC |

TABLE 9-LD-continued

| Target ID | Hairpin Sequence 5' → 3' |
|---|---|
| LD014 | SEQIDNO: 245<br>GCCCTTCGCAGATCAAGCATATGATGGCTTTCATTGAACAAGAGGCAAACGAAAAGGCAGAAGAAATCGATGCCAAGGCCGAGGAAG<br>AATTTAATATTGAAAAGGGGCGCCTTGTTCAGCAACAACGTCTCAAGATTATGGAATATTATGAGAAGAAAGAGAAACAGGTCGAACT<br>CCAGAAAAAAATCCAATCGTCTAACATGTTGAATCAGGCTCGATTGAAAGTATTGAAGGTTAGGGAAGATCACGTTCGTACCGTACTA<br>GAGGAGGCGCGTAAACGACTTGGTCAGGTCACAAACGACCAGGGAAAATATTCCCAAATCCTGGAAAGCCTCATTTTGCAGGGATTA<br>TATCAGCTTTTTGAGAAAGATGTTACCATTCGAGTTCGGCCCCAGGACCGAGAACTGGTCAAATCCATCATTCCCACCGTCACGAACA<br>AGTATAAAGATGCCACCGGTAAGGACATCCATCTGAAAATTGATGACGAAATCCATCTGTCCCAAGAAACCACCGGGGGAATCGACC<br>TGCTGGCGCAGAAAAACAAAATCAAGATCAGCAATACTATGGAGGCTCGTCTGGAGCTGATTTCGCAGCAACTTCTGCCCGAGATCC<br>GAAGGGCGAATTCACCAGCTTTCTTGTACAAAGTGGTATATCACTAGTGCGGCCGCCTGCAGGTCGACCATATGGTCGACCTGCAGG<br>CGGCCGCACTAGTGATGCTGTTATGTTCAGTGTCAAGCTGACCTGCAAACACGTTAAATGCTAAGAAGTTAGAATATATGAGACACGT<br>TAACTGGTATATGAATAAGCTGTAAATAACCGAGTATAAACTCATTAACTAATATCACCTCTAGAGTATAATATAATCAAATTCGACAAT<br>TTGACTTTCAAGAGTAGGCTAATGTAAAATCTTTATATATTTCTACAATGTTCAAAGAAACAGTTGCATCTAAACCCCTATGGCCATCAA<br>ATTCAATGAACGCTAAGCTGATCCGGCGAGATTTTCAGGAGCTAAGGAAGCTAAAATGGAGAAAAAAATCACTGGATATACCACCGTT<br>GATATATCCCAATGGCATCGTAAAGAACATTTTGAGGCATTTCAGTCAGTTGCTCAATGTACCTATAACCAGACCGTTCAGCTGGATAT<br>TACGGCCTTTTTAAAGACCGTAAAGAAAATAAGCACAAGTTTATCCGGCCTTTATTCACATTCTTGCCCGCCTGATGAATGCTCATC<br>CGGAATTCCGTATGGCAATGAAAGACGGTGAGCTGGTGATATGGGATAGTGTTCACCCTTGTTACACCGTTTTCCATGAGCAAACTGA<br>AACGTTTTCATCGCTCTGGAGTGAATACCACGACGATTTCCGGCAGTTCTTACACATATATTCGCAAGATGTGGCGTGTTACGGTGAA<br>AACCTGGCCTATTTCCCTAAAGGGTTTATTGAGAATATGTTTTTCGTCTCAGCCAATCCCTGGGTGAGTTTCACCAGTTTTGATTTAAA<br>CGTGGCCAATATGGACAACTTCTTCGCCCCCGTTTTCACCATGGGCAAATATTATACGCAAGGCGACAAGGTGCTGATGCCGCTGGC<br>GATTCAGGTTCATCATGCCGTCTGTGATGGCTTCCATGTCGGCAGAATGCTTAATGAATTACAACAGTACTGCGATGAGTGGCAGGG<br>CGGGGCGTAAACGCGTGGATCAGCTTAATATGACTCTCAATAAAGTCTCATACCAACAAGTGCCACCTTATTCAACCATCAAGAAAAA<br>AGCCAAAATTTATGCTACTCTAAGGAAAACTTCACTAAAGAAGACGATTTAGAGTGTTTTACCAAGAATTTCTGTCATCTTACTAAACAA<br>CTAAAGATCGGTGTGATACAAAACCTAATCTCATTAAAGTTTATGCTAAAATAAGCATAATTTTACCCACTAAGCGTGACCAGATAAACA<br>TAACTCAGCACACCAGAGCATATATATTGGTGGCTCAAATCATAGAAACTTACAGTGAAGACACAGAAAGCCGTAAGAAGAGGCAAGA<br>GTATGAAACCTTACCTCATCATTTCCATGAGGTTGCTTCTGATCCCGCGGGATATCGACCACTTTGTACAAGAAAGCTGGGTCGAATT<br>CGCCCTTCGGATCTCGGGCAGAAGTTGCTGCGAAATCAGCTCCAGACGAGCCTCCATAGTATTGCTGATCTTGATTTTGTTTTTCTGC<br>GCCAGCAGGTCGATTCCCCCGGTGGTTTCTTGGGACAGATGGATTTCGTCATCAATTTTCAGATGGATGTCCTTACCGGTGGCATCTT<br>TATACTTGTTCGTGACGGTGGGAATGATGGATTTGACCAGTTCTCGGTCCTGGGGCCGAACTCGAATGGTAACATCTTTCTCAAAAAG<br>CTGATATAATCCCTGCAAAATGAGGCTTTCCAGGATTTGGGAATATTTTCCCTGGTCGTTTGTGACCTGACCAAGTCGTTTACGCGCC<br>TCCTCTAGTACGGTACGAACGTGATCTTCCCTAACCTTCAATACTTTCAATCGAGCCTGATTCAACATGTTAGACGATTGGATTTTTTT<br>CTGGAGTTCGACCTGTTTCTCTTTCTTCTCATAATATTCCATAATCTTGAGACGTTGTTGCTGAACAAGGCGCCCCTTTTCAATATTAAA<br>TTCTTCCTCGGCCTTGGCATCGATTTCTTCTGCCTTTTCGTTTGCCTCTTGTTCAATGAAAGCCATCATATGCTTGATCTGCGAAGGGC |
| LD016 | SEQIDNO: 246<br>GCCCTTGGAATAGGATGGGTAATGTCGTCGTTGGGCATAGTCAATATAGGAATCTGGGTGATGGATCCGTTACGTCCTTCAACACGG<br>CCGGCACGTTCATAGATGGTAGCTAAATCGGTGTACATGTAACCTGGGAAACCACGACGACCAGGCACCTCTTCTCTGGCAGCAGAT<br>ACCTCACGCAAAGCTTCTGCATACGAAGACATATCTGTCAAGATGACCAAGACGTGCTTCTCACATTGGTAAGCCAAGAATTCGGCAG<br>CTGTCAAAGCCAGACGAGGTGTAATAATTCTTTCAATGGTAGGATCGTTGGCCAAATTCAAGAACAGGCAGACATTCTCCATAGAACC<br>GTTCTCTTCGAAATCCTGTTTGAAGAACCTAGCTGTTTCCATGTTAACACCCATAGCAGCGAAAACAATAGCAAAGTTATCTTCATGAT<br>CATCAAGTACAGATTTACCAGGAATCTTGACTAAACCAGCCTGTCTACAGATCTGGGCAGCAATTTCATTGTGAGGCAGACCAGCTGC<br>AGAGAAAATGGGGATCTTCTGACCACGAGCAATGGAGTTCAATGCTCAATAGCTGTAATACCCGTCTGGATCATTTCCTCAGGATAG<br>ATACGGGACCACGGATTGATTGGTTGACCCTGGATGTCCAAGAAGTCTTCAGCCAAAATTGGGGGACCTTTGTCGATGGGTTTTCCT<br>GATCCATTGAAAACACGTCCCAACATATCTTCAGAAACAGGAGTCCTCAAAATATCTCCTGTGAATTCACAAGCGGTGTTTTGGCGT<br>CGATTCCTGATGTGCCCTCGAACACTTGAACCACAGCTTTTGACCCACTGACTTCCAGAACTTGTCCCGAACGTATAGTGCCATCAGC<br>CAGTTTGAGTTGTACGATTTCATTGTACTTGGGGAACTTAACATCTTCGAGGATTACCAGAGGACCGTTCACACCAGACACAGTCAAG<br>GGCGAATTCACCAGCTTTCTTGTACAAAGTGGTATATCACTAGTGCGGCCGCCTGCAGGTCGACCATATGGTCGACCTGCAGGCGG<br>CCGCACTAGTGATGCTGTTATGTTCAGTGTCAAGCTGACCTGCAAACACGTTAAATGCTAAGAAGTTAGAATATATGAGACACGTTAA<br>CTGGTATATGAATAAGCTGTAAATAACCGAGTATAAACTCATTAACTAATATCACCTCTAGAGTATAATATAATCAAATTCGACAATTTG<br>ACTTTCAAGAGTAGGCTAATGTAAAATCTTTATATATTTCTACAATGTTCAAAGAAACAGTTGCATCTAAACCCCTATGGCCATCAAATT<br>CAATGAACGCTAAGCTGATCCGGCGAGATTTTCAGGAGCTAAGGAAGCTAAAATGGAGAAAAAATCACTGGATATACCACCGTTGAT<br>ATATCCCAATGGCATCGTAAAGAACATTTTGAGGCATTTCAGTCAGTTGCTCAATGTACCTATAACCAGACCGTTCAGCTGGATATTAC<br>GGCCTTTTTAAAGACCGTAAAGAAAATAAGCACAAGTTTATCCGGCCTTTATTCACATTCTTGCCCGCCTGATGAATGCTCATCCGG<br>AATTCCGTATGGCAATGAAAGACGGTGAGCTGGTGATATGGGATAGTGTTCACCCTTGTTACACCGTTTTCCATGAGCAAACTGAAAC<br>GTTTTCATCGCTCTGGAGTGAATACCACGACGATTTCCGGCAGTTTCTACACATATATTCGCAAGATGTGGCGTGTTACGGTGAAAAC<br>CTGGCCTATTTCCCTAAAGGGTTTATTGAGAATATGTTTTTCGTCTCAGCCAATCCCTGGGTGAGTTTCACCAGTTTTGATTTAAACGT<br>GGCCAATATGGACAACTTCTTCGCCCCCGTTTTCACCATGGGCAAATATTATACGCAAGGCGACAAGGTGCTGATGCCGCTGGCGAT<br>TCAGGTTCATCATGCCGTCTGTGATGGCTTCCATGTCGGCAGAATGCTTAATGAATTACAACAGTACTGCGATGAGTGGCAGGGCGG<br>GGCGTAAACGCGTGGATCAGCTTAATATGACTCTCAATAAAGTCTCATACCAACAAGTGCCACCTTATTCAACCATCAAGAAAAAAGC<br>CAAAATTTATGCTACTCTAAGGAAAACTTCACTAAAGAAGACGATTTAGAGTGTTTTACCAAGAATTTCTGTCATCTTACTAAACAACTA<br>AAGATCGGTGTGATACAAAACCTAATCTCATTAAAGTTTATGCTAAAATAAGCATAATTTTACCCACTAAGCGTGACCAGATAAACATAA<br>CTCAGCACACCAGAGCATATATATTGGTGGCTCAAATCATAGAAACTTACAGTGAAGACACAGAAAGCCGTAAGAAGAGGCAAGAGT<br>ATGAAACCTTACCTCATCATTTCCATGAGGTTGCTTCTGATCCCGCGGGATATCACCACTTTGTACAAGAAAGCTGGGTCGAATTCGC<br>CCTTGACTGTGTCTGGTGTGAACGGTCCTCTGGTAATCCTCGAAGATGTTAAGTTCCCAAGTACAATGAAATCGTACAACTCAAACT<br>GGCTGATGGCACTATACGTTCGGGACAAGTTCTGGAAGTCAGTGGGTCAAAAGCTGTGGTTCAAGTGTTCGAGGGCACATCAGGAAT<br>CGACGCCAAAAACACCGCTTGTGAATTCACAGGAGATATTTTGAGGACTCCTGTTTCTGAAGATATGTTGGGACGTGTTTTCAATGGA<br>TCAGGAAAACCCATCGACAAAGGTCCCCAATTTTGGCTGAAGACTCTTGGACATCCAGGGTCAACCAATCAATCCGTGGTCCCGT<br>ATCTATCCTGAGGAAATGATCCAGACGGGTATTACAGCTATTGACGTGATGAATCCATCCTTTGCTCGTGGTCAGAAGATCCCCATTTTCT<br>CTGCAGCTGGTCTGCCTCACAATGAAATTGCTGCCCAGATCTGTAGACAGGCTGGTTTAGTCAAGATTCCTGGTAAATCTGTACTTGA<br>TGATCATGAAGATAACTTTGCTATTGTTTTCGCTGCTATGGGTGTTAACATGGAAACAGCTAGGTTCTTCAAACAGGATTTCGAAGAGA<br>ACGGTTCTATGGAGAATGTCTGCCTGTTCTTGAATTTGGCTAACGATCCTACCATTGAAAGAATTATTACACCTCGTCTGGCTTTGACA<br>GCTGCCGAATTCTTGGCTTACCAATGTGAGAAGCACGTCTTGGTCATCTTGACAGATATGTCTTCGTATGCAGAAGCTTTGCGTGAGG<br>TATCTGCTGCCAGAGAAGAGGTGCCTGGTCGTCGTGGTTTCCCAGGTTACATGTACACCGATTTAGCTACCATCTATGAACGTGCCG<br>GCCGTGTTGAAGGACGTAACGGATCCATCACCCAGATTCCTATATTGACTATGCCCAACGACGACATTACCCATCCTATTCCAAGGGC |

TABLE 9-LD-continued

| Target ID | Hairpin Sequence 5' → 3' |
|---|---|
| LD027 | SEQIDNO 2486<br>GGGAGCAGACGATCGGTTGGTTAAAATCTGGGACTATCAAAACAAAACGTGTGTCCAAACCTTGGAAGGACACGCCCAAAACGTAAC<br>CGCGGTTTGTTTCCACCCTGAACTACCTGTGGCTCTCACAGGCAGCGAAGATGGTACCGTTAGAGTTTGGCATACGAATACACACAG<br>ATTAGAGAATTGTTTGAATTATGGGTTCGAGAGAGTGTGGACCCATTTGTTGCTTGAAGGGTTCGAATAATGTTTCTCTGGGGTATGAC<br>GAGGGCAGTATATTAGTGAAAGTTGGAAGAGAAGAACCGGCAGTTAGTATGGATGCCAGTGGCGGTAAAATAATTTGGGCAAGGCAC<br>TCGGAATTACAACAAGCTAATTTGAAGGCGCTGCCAGAAGGTGGAGAAATAAGAGATGGGGAGCGTTTACCTGTCTCTGTAAAGAT<br>ATGGGAGCATGTGAAATATACCCTCAAACAATCCAACATAATCCGAATGGAAGATTCGTTGTAGTATGCGGAGACGGCGAATATATCA<br>TTTACACAGCGATGGCTCTACGGAACAAGGCTTTTGGAAGCGCTCAAGAGTTTGTCTGGGCTCAGGACTCCAGCGAGTATGCCATTC<br>GCGAGTCTGGTTCTCCACAATTCGGATATTCAAAAACTTCAAAGAAAAGGAAGAACTTCAAGTCGGATTTCAGCGCGGAAGGAATCTACG<br>GGGGTTTTCTCTTGGGGATTAAATCGGTGTCCGGTTTAACGTTTTACGATTGGGAAACTTTGGACTTGGTGAGACGGATTGAAATACA<br>ACCGAGGGCGGTTTATTGGTCTGACAGTGGAAAATTAGTCTGTCTCGCAACGGAGGACAGCTACTTCATCCTTTCTTATGATTCGGAG<br>CAAGTTCAGAAGGCCAGGGAGAACAATCAAGTCGCAGAGGATGGCGTAGAGGCCGCTTTCGATGTGTTGGGGGAAATGAACGAGTC<br>TGTCCGAACCCAGCTTTCTTGTACAAAGTGGTGATATCCCGCGGGATCAGAAGCAACCTCATGGAAATGATGAGGTAAGGTTTCATAC<br>TCTTGCCTCTTCTTACGGCTTTCTGTGTCTTCACTGTAAGTTTCTATGATTTGAGCCACCAATATATATGCTCTGGTGTGCTGAGTTATG<br>TTTATCTGGTCACGCTTAGTGGGTAAAATTATGCTTATTTTAGCATAAACTTTAATGAGATTAGGTTTTGTATCACACCGATCTTTAGTT<br>GTTTAGTAAGATGACAGAAATTCTTGGTAAAACACTCTAAATCGTCTTCTTTAGTGAAGTTTTCCTTAGAGTAGCATAAATTTTGGCTTT<br>TTTCTTGATGGTTGAATAAGGTGGCACTTGTTGGTATGAGACTTTATTGAGAATCATATTAAGCTGATCCACGCGTTTACGCCCCGCC<br>CTGCCACTCATCGCAGTACTGTTGTAATTCATTAAGCATTCTGCCGACATGGAAGCCATCACAGACGCATGATGAACCTGAATCGCC<br>AGCGGCATCAGCACCTTGTCGCCTTGCGTATAATATTTGCCCATGGTGAAAACGGGGGCGAAGAAGTTGTCCATATTGGCCACGTTT<br>AAATCAAAACTGGTGAAACTCACCCAGGGATTGGCTGAGACGAAAAACATATTCTCAATAAACCCTTTAGGGAAATAGGCCAGGTTTT<br>CACCGTAACGCCACATCTTGCGATATATGTGTAGAAACTGCCGGAAATCGTCGTGGTATTCACTCCAGAGCGATGAAAACGTTTC<br>AGTTTGCTCATGGAAAACGGTGTAACAAGGGTGAACACTATCCATATCACCAGCTCACCGTCTTCATTGCCATACGGAATTCCGGA<br>TGAGCATTCATCAGGCGGGCAAGATGTGAATAAAGGCCGGATAAAACTTGTGCTTATTTTTCTTTACGGTCTTTAAAAAGGCCGTAAT<br>ATCCAGCTGAACGGTCTGGTTATAGGTACATTGAGCAACTGACTGAAATGCCTCAAAATGTTCTTTACGATGCCATTGGGATATATCAA<br>CGGTGGTATATCCAGTGATTTTTTTCTCCATTTTAGCTTCCTTAGCTCCTGAAAATCTCGCCGGATCAGCTTAGCGTTCATTGAATTTG<br>ATGGCCATAGGGGTTTAGATGCAACTGTTTCTTTGAACATTGTAGAAATATATAAAGATTTTACATTAGCTACTCTTGAAAGTCAAATT<br>GTCGAATTTGATTATATTATACTCTAGAGGTGATATTAGTTAATGAGTTTATACTCGGTTATTTACAGCTTATTCATATACCAGTTAACGT<br>GTCTCATATATTCTAACTTCTTAGCATTTAACGTGTTTGCAGGTCAGCTTGACACTGAACATAACAGCATCACTAGTGCGGCCGCCTG<br>CAGGTCGACCATATGGTCGACCTGCAGGCGGCCGCACTAGTGATATACCACTTTGTACAAGAAAGCTGGTCGAATTCGCCCTTTCGG<br>ACAGACTCGTTCATTTCCCCCAACACATCGAAAGCGGCCTCTACGCCATCCTCTGCGACTTGATTGTTCTCCCTGGCCTTCTGAACTT<br>GCTCCGAATCATAAGAAAGGATGAAGTAGCTGTCCTCCGTTGCGAGACAGACTAATTTTCCACTGTCAGACCAATAAACCGCCCTCG<br>GTTGTATTTCAATCCGTCTCACCAAGTCCAAAGTTTCCCAATCGTAAAACGTTAAACCGGACACCGATTTAATCCCCAAGAGAAACCC<br>CCGTAGATTCCTTCCGCGCTGAAATCCGACTTGAAGTTCTTCCTTTCTTTGAAGTTTTTGAATATCCGAATTGTGGAACCAGACTCGCG<br>AATGGCATACTCGCTGGAGTCCTGAGCCCAGACAAACTCTTGAGCGCTTCCAAAAGCCTTGTTCCGTAGAGCCATCGCTGTGTAAAT<br>GATATATTCGCCGTCTCCGCATACTACAACGAATCTTCCATTCGACGATTATGTTGGATTGTTTGAGGGTATATTTCACATGCTCCCATAT<br>CTTTTACAGAGACAGGTAAACGCTCCCCATCTCTTATTTCTCCACCTTCTTGGCAGCGCCTTCAAATTAGCTTGTTGTAATTCCGAGTGC<br>CTTGCCCAAATTATTTTACCGCCACTGGCATCCATACTAACTGCCGGTTCTTCTCTTCCAACTTTCACTAATATACTGCCCTCGTCATA<br>CCCCAGAGAAACATTATTCGAACCCTTCAAGCAACAAATGGTCCACACTCTCGAACCCATAATTCAAACAATTCTCTAATCTGTGTG<br>TATTCGTATGCCAAACTCTAACGGTACCATCTTCGCTGCCTGTGAGAGCCACAGGTAGTTCAGGGTGGAAACAAACCGCGGTTACGT<br>TTTGGGCGTGTCCTTCCAAGGTTTGGACACACGTTTTGTTTTGATAGTCCCAGATTTTAACCAACCGATCGTCTGCTCCC |

TABLE 9-PC

| Target ID | Hairpin Sequence 5' → 3' |
|---|---|
| PC001 | SEQ ID NO: 508<br>AGATTCAAATTTGATGTAGTCAAGAATTTTAGATGTAGCAATTTCCATTTGAATTGTGTCATTCACTTTGATGTTGGGGTCAGGGTAACGA<br>ATGGTTCTGCCATCATGTGTTACCAAAAATGGGATTCCTTTGGGACCAGTTTGGACTCTCCTTACTTTACACAACTTGTATTTTGCCTCTT<br>CAGCTGTAATACGGTGCACAGCAAATCTTCCTTTAACATCATAGATCAGACGGAAAAATTCACCAGTCTTCTCAATAGTAATGACATCCA<br>TGAAACCAGCAGGGTAATTAGAATCAGTCCTCACTTTACCATCAACTTTGATCAACCTTTGCATGACAATTTTAGTGACTTCACTGTTTGT<br>AAGGGCATACTTCAGCCTGTTACGAAGGAAAATCACTAAAGGCAGGGATTCGCGCAACTTGTGAGGCCCGGTGGATGGACGAGGGGC<br>GAAGACACCCCCAATTTGTCCAACATCCATGCAAGGGCGAATTCGACCCGATGCTTCTTGTACAAAGTGGTGATATCACTAGTGCGGCC<br>GCCTGCAGGTCGACCATATGGTCGACCTGCAGGCGGCCGCACTAGTGATGCTGTTATGTTCAGTGTCAAGCTGACCTGCAAACACGTT<br>AAATGCTAAGAAGTTAGAATATATGAGACACGTTAACTGGTATATGAATAAGCTGTAAATAACCGAGTATAAACTCATTAACTAATATCAC<br>CTCTAGAGTATAATAATCAAATTTGACAATTTCAAGAGTAGGCTAATTGTAAAATCTTTTATATATTTCTACAATGTTCAAAGAAA<br>CAGTTGCATCTAAACCCCTATGGCCATCAAATTCAATGAACGCTAAGCTGATCCGGCGAGATTTCAGGAGCTAAGGAAGCTAAAATGG<br>AGAAAAAATCACTGGATATACCACCGTTGATATATCCCAATGGCATCGTAAAGAACATTTTGAGGCATTTCAGTCAGTTGCTCAATGTA<br>CCTATAACCAGACCGTTCAGCTGGATATTACGGCCTTTTTAAAGACCGTAAAGAAAATAAGCACAAGTTTTATCCGGCCTTTATTCACA<br>TTCTTGCCCGCCTGATGAATGCTCATCCGGAATTCCGTATGCAATAGAAAGACGGTGAGCTGGTGATATGGGATAGTGTTCACCCTTGT<br>TACACCGTTTTCCATGAGCAAACTGAAACGTTTTCATCGCTCTGGAGTGAATACCACGACGATTTCCGGCAGTTTCTACACATATATTCG<br>CAAGATGTGGCGTGTTACGGTGAAAACCTGGCCTATTTCCCTAAAGGGTTTATTGAGAATATGTTTTCGTCTCAGCCAATCCCTGGGT<br>GAGTTTCACCAGTTTTGATTTAAACGTGGCCAATATGGACAACTTCTTCGCCCCCGTTTTCACCATGGGCAAATATTATACGCAAGGCGA<br>CAAGGTGCTGATGCCGCTGGCGATTCAGGTTCATCATGCCGTCTGTGATGGCTTCCATGTCGGCAGAATGCTTAATGAATTACAACAGT<br>ACTGCGATGAGTGGCAGGGCGGGGCGTAAACGCGTGGATCAGCTTAATATGACTCTCAATAAAGTTCATCAACAAGTGCCACCTT<br>ATTCAACCATCAAGAAAAAGCCAAATTTATGCTACTCTAAGGAAAACTTCACTAAAGAAGACGATTTAGAGTGTTTTACCAAGAATTTC<br>TGTCATCTTACTAAACAACTAAAGATCGGTGTGATACAAAACCTAATCTCATTAAAGTTTATGCTAAAATAAGCATAATTTTTACCCACTAAG<br>CGTGACCAGATAACATAACTCAGCAGACAGAGCATAATATTGGTGGCTCAAATCATAGAAAACTTACAGTGAAGACACAGAAAAAGCCG<br>TAAGAAGAGGCAAGAGTATGAAACCTTACCTCATCATTTCCATGAGGTTGCTTCTGATCCCGCGGGATATCACCACTTTGTACAAGAAA<br>GCTGGGTCGAATTCGCCCTTGCATGGATGTTGGACAAATTGGGGGGTGTCTTCGCCCCTCGTCCATCCACCGGGCCTCACAAGTTGCG<br>CGAATCCCTGCCTTTAGTGATTTTCCTTCGTAACAGGCTGAAGTATGCCCTTACAAACAGTGAAGTCACTAAAATTGTCATGCAAAGGTT<br>GATCAAAGTTGATGGTAAAGTGAGGACTGATTCTAATTACCCTGCTGGTTTCATGGATGTCATTACTATTGAGAAGACTGGTGAATTTTT<br>CCGTCTGATCTATGATGTTAAAGGAAGATTTGCTGTGCACCGTATTACAGCTGAAGAGGCAAAATACAAGTTGTAAAGTAAGGAGAG |

TABLE 9-PC-continued

| Target ID | Hairpin Sequence 5' → 3' |
|---|---|
| | TCCAAACTGGTCCCAAAGGAATCCCATTTTTGGTAACACATGATGGCAGAACCATTCGTTACCCTGACCCCAACATCAAAGTAATGAC<br>ACAATTCAAATGGAAATTGCTACATCTAAAATTCTTGACTACATCAAATTTGAATCT |
| PC010 | SEQ ID NO: 509<br>CTCTCAAGGATTCTTTGCAGATGTCGCTCAGCCTATTACCGCCCAACGCGTTGATTGGATTGATCACGTTCGGAAAAATGGTGCAAGTC<br>CACGAACTGGGTACCGAAGGCTGCAGCAAGTCGTACGTGTTCTGTGGAACGAAAGATCTCACCGCCAAGCAAGTCCAGGAGATGTTG<br>GGCATTGGAAAAGGGTCACCAAATCCCCAACAACAGCCAGGGCAACCTGGGCGGCCAGGGCAGAATCCCCAAGCTGCCCCTGTACCA<br>CCGGGGAGCAGATTCTTGCAGCCCGTGTCAAAATGCGACATGAACTTGACAGATCTGATCGGGGAGTTGCAGAAAGACCCTTGGCCC<br>GTACATCAGGGCAAAAGACCTCTTAGATCCACAGGCGCAGCATTGTCCATCGCTGTCGGCCTCTTAGAATGCACCTATCCGAATACGG<br>GTGGCAGAATCATGATATTCTTAGGAGGACCATGCTCTCAGGGTCCCGGCCAGGTGTTGAACGACGATTTGAAGCAGCCCATCAGGTC<br>CCATCATGACATACACAAAGACAATGCCAAGTACATGAAGAAGGCTATCAAACATTACGATCACTTGGCAATGCGAGCTGCCACCAACA<br>GCCATTGCATCGACATTTACTCCTGCGCCCTGGATCAGACGGGACTGATGGAGATGAAGCAGTGCTGCAATTCCACCGGAGGGCACAT<br>GGTCATGGGCGATTCCTTCAATTCCTCTCTATTCAAACAAACCTTCCAGCGAGTGTTCTCAAAAGACCCGAAGAACGACCTCAAGATGG<br>CGTTCAACGCCACCTTGGAGGTGAAGTGTTCCAGGGAGTTAAAAGTCCAAGGGGGCATCGGCTCGTGCGTGTCCTTGAACGTTAAAAG<br>CCCTCTGGTTTCCGATACGGAACTAGGCATGGGGAATACTGTGCAGTGGAAACTTTGCACGTTGGCGCCGAGCTCTACTGTGGCGCTG<br>TTCTTCGAGGTGGTTAACCAGCATTCGGCGCCCATACCACAGGGAGGCAGGGGCTGCATCCAGCTCATCACCCAGTATCAGCACGCG<br>AGCGGGCAAAGGAGGATCAGAGTGACCACGATTGCTAGAAATTGGGCGGACGCTACTGCCAACATCCACCACATTAGCGCTGGCTTC<br>GACCAAGAAGCGGCGGCAGTTGTGATGGCCCGAATGGCCGGTTAAAACGGCGGAATCGGACGAGACTCCCGACGTGCTCAGATGGGT<br>GGACAGGATGTTGATCAGGCTGTGCCAGAAGTTCGGAGAGTACAATAAAGACGATCCGAATTCGTTCAGGTTGGGGGAGAACTTCAGT<br>CTGTATCCGCAGTTCATGTACCATTTGAGACGGTCGCAGTTTCTGCAGGTGTTCAATAATTCTCCTGATGAAACGTCGTTTTATAGGCAC<br>ATGCTGATGCGTGAGGATTTGACTCAGTCTTTGATCATGATCCAGCCGATTTTGTACAGTTACAGCTTCAACGGGCCGCCCGAGCCTGT<br>GTTGTTGGACACAAGCTCTATTCAGCCGGATAGAATCCTGCTCATGGACACTTTCTTCCAGATACTCATTTTCCATGGAGAGACCATTGC<br>CCAATGGCGAAGGGCGAATTCGACCCAGCTTTCTTGTACAAAGTGGTGATATCACTAGTGCGGCCGCCTGCAGGTCGACCATATGGTC<br>GACCTGCAGGCGGCCGCACTAGTGATGCTGTTATGTTCAGTGTCAAGCTGACCTGCAAACACGTTAAATGCTAAGAAGTTAGAATATAT<br>GAGACACGTTAACTGGTATATGAATAAGCTGTAAATAACCGAGTATAAACTCATTAACTAATATCACCTCTAGAGTATAATATAATCAAAT<br>TCGACAATTTGACTTTCAAGAGTAGGCTAATGTAAAATCTTTATATATTTCTACAATGTTCAAAGAAACAGTTGCATCTAAACCCCTATGG<br>CCATCAAATTCAATGAACGCTAAGCTGATCCGGCGAGATTTTCAGGAGCTAAGGAAGCTAAAATGGAGAAAAAAATCACTGGATATACC<br>ACCGTTGATATATCCCAATGGCATCGTAAAGAACATTTTGAGGCATTTCAGTCAGTTGCTCAATGTACCTATAACCAGACCGTTCAGCTG<br>GATATTACGGCCTTTTTAAAGACCGTAAAGAAAAATAAGCACAAGTTTTATCCGGCCTTTATTCACATTCTTGCCCGCCTGATGAATGCT<br>CATCCGGAATTCGTATGGCAATGAAAGACGGTGAGCTGGTGATATGGGATAGTGTTCACCCTTGTTACACCGTTTTCCATGAGCAAAC<br>TGAAACGTTTTCATCGCTCTGGAGTGAATACCACGACGATTTCCGGCAGTTTCTACACATATATTCGCAAGATGTGGCGTGTTACGGTG<br>AAAACCTGGCCTATTTCCCTAAAGGGTTTATTGAGAATATGTTTTCGTCTCAGCCAATCCCTGGGTGAGTTTCACCAGTTTTGATTTAAA<br>CGTGGCCAATATGGACAACTTCTTCGCCCCCGTTTTCACCATGGGCAAATATTATACGCAAGGCGACAAGGTGCTGATGCCGCTGGCG<br>ATTCAGGTTCATCATGCCGTCTGTGATGGCTTCCATGTCGGCAGAATGCTTAATGAATTACAACAGTACTGCGATGAGTGGCAGGGCGG<br>GGCGTAAACGCGTGGATCAGCTTAATATGACTCTCAATAAAGTCTCATACAACAAGTGCCACCTTTATTCAACCATCAAGAAAAAAGCCA<br>AAATTTATGCTACTCTAAGGAAAACTTCACTAAAGAAGACGATTTAGAGTGTTTTACCAAGAATTTCTGTCATCTTACTAAACAACTAAAG<br>ATCGGTGTGATACAAAACCTAATCTCATTAAAGTTTATGCTAAATAAGCATAATTTTACCCACTAAGCGTGACCAGATAAACATAACTCA<br>GCACACCAGAGCATATATATTGGTGGCTCAAATCATAGAAACTTACAGTGAAGACACAGAAAGCCGTAAGAAGAGGCAAGAGTATGAAA<br>CCTTACCTCATCATTTCCATGAGGTTGCTTCTGATCCCGCGGAATCACCACTTTGTACAAGAAAGCTGGGTCGAATTCGCCCTTCGC<br>CATTGGGCAATGGTCTCTCCATGGAAAATGAGTATCTGGAAGAAAGTGTCCATGAGCAGGATTCTATCCGGCTGAATAGAGCTTGTGTC<br>CAACAACACAGGCTCGGGCGGCCCGTTGAAGCTGTAACTGTACAAAATCGGCTGGATCATGATCAAAGACTGAGTCAAATCCTCACGC<br>ATCAGCATGTGCCTATAAAACGACGTTTCATCAGGAGAATTATTGAACACCTGCAGAAACTGCGACCGTCTCAAATGGTACATGAACTG<br>CGGATACAGACTGAAGTTCTCCCCCAACCTGAACGAATTCCGATTTTGCTACTCTCCGAACTTCTGGACATTGCTTGCACAGCCTGATCAACA<br>TCCTGTCCACCCATCTGAGCACGTCGGGAGTCTCGTCCGATTCCGCCTTGTAACCGGCCATTCGGGCCATCACAACTGCCGCCGCTTC<br>TTGGTCGAAGCCAGCGCTAATGTGGTGGATGTTGGCAGTAGCGTCCGCCCAATTTCTAGCAATCGTGGTCACTCTGATCCTCCTTTGCC<br>CGCTCGCGTGCTGATACTGGGTGATGAGCTGGATGCAGCCCCTGCCTCCCTGTGGTATGGGCGCCGAATGCTGGTTAACCACCTCGA<br>AGAACAGCGCCACAGTAGAGCTCGGCGCCAACGTGCAAAGTTTCACAGTATTCCCCATGCCTAGTTCCGTATCGGAAACCAG<br>AGGGCTTTTAACGTTCAAGGACACGCACGAGCCGATGCCCCCTTGGACTTTTAACTCCCTGGAACACTTCACCTTCCAAGGTGGCGTTG<br>AACGCCATCTTGAGGTCGTTCTTCGGGTCTTTTGAGAACACTCGCTGGAAGGTTTGTTTGAATAGAGAGGAATTGAAGGAATCGCCCAT<br>GACCATGTGCCCTCCGGTGGAATTGCAGCACTGCTTCATCTCCATCAGTCCCGTCTGATCCAGGGCGCAGGAGTAAATGTCGATGCAA<br>TGGCTGTTGGTGGCAGCTCGCATTGCCAAGTGATCGTAATGTTTCAAGATCCTTCTTCATGTACTTGGCGTTGTCTTTGTGTATGTCATGA<br>TGGGACCTGATGGGCTGCTTCAAATCGTCGTTCAACACCTGGCCGGGACCCTGAGAGCATGGTCCTCCTAAGAATATCATGATTCTGC<br>CACCCGTATTCGGATAGGTGCATTCTAAGAGGCCGACAGCGATGGACAATGCTGCGCCTGTGGATCTAAGAGGTCTTTTGCCCTGATG<br>TACGGGCCAAGGGTCTTTCTGCAACTCCCCGATCAGATCTGTCAAGTTCATGTCGCATTTTGACACGGGCTGCAAGAATCTGCTCCCG<br>GTGGTACAGGGGCAGCTTGGGGATTCTGCCCTGGCCGCCCAGGTTGCCCTGGCTGTTGTTGGGGATTTGGTGACCCTTTTCCAATGC<br>CCAACATCTCCTGGACTTGCTTGGCGGTGAGATCTTTCGTTCCACAGAACACGTACGACTTGCTGCAGCCTTCGGTACCCAGTTCGTG<br>GACTTGCACCATTTTTCCGAACGTGATCAATCCAATCAACGCGTTGGGCGGTAATAGGCTGAGCGACATCTGCAAAGAATCCTTGAGAG |
| PC014 | SEQ ID NO: 510<br>CGCAGATCAAACATATGATGGCTTTCATTGAACAAGAAGCCAATGAGAAAGCAGAAGAAATCGATGCCAAGGCAGAGGAGGAATTCAAC<br>ATTGAAAAGGGCGTTTAGTCCAGCAACAGAGACTCAAGATCATGGAGTACTACGAGAAAAAGGAGAAGCAAGTCGAACTTCAAAAGAA<br>AATTCAGTCCTCTAATATGTTGAATCAGGCTCGTTTGAAGGTGCTGAAAGTGAGAGAGGACCATGTCAGAGCAGTCCTGGAGGATGCTC<br>GTAAAAGTCTTGGTGAAGTAACCAAAGACCAAGGAAAATACTCCCAAATTTTGGAGAGCCTAATCCTACAAGGACTGTTCCAGCTGTTC<br>GAGAAGGAGGTGACGGTCCGCGTGAGACCGCAAGATAGGGACTTGGTTAGGTCCATCTGCCCAACGTCGTGCCAAATACAAGGAC<br>GCCACCGGCAAAGACATCCTACTCAAGGTGGAACGATGAGTCGCACCTGTCTCAGGAGATCACCGGAGGCGTCGATCTGCTCGCTCAG<br>AAGAACAAGATCAAGATCAGCAACACGATGGAGGTAGGTTGGATCTGATCGCTCAGCAATTGTGCCCGAGATCCGAAGGGCAATT<br>CGACCCAGCTTTCTTGTACAAAGTGGTGATATCACTAGTGCGGCCGCCTGCAGGTCGACCATATGGTCGACCTGCAGGCGGCCGCACT<br>AGTGATGCTGTTATGTTCAGTGTCAAGCTGACCTGCAAACACGTTAAATGCTAAGAAGTTAGAATATATGAGACACGTTAACTGGTATAT<br>GAATAAGCTGTAAATAACCGAGTATAAACTCATTAACTAATATCACCTCTAGAGTATAATATAATCAAATTTGACTTTCAAGAG<br>TAGGCTAATGTAAAATCTTTATATATTTCTACAATGTTCAAAGAAACAGTTGCATCTAAACCCCTATGGCCATCAAATTCAATGAACGCTA<br>AGCTGATCCGGCGAGATTTTCAGGAGCTAAGGAAGCTAAAATGGAGAAAAAAATCACTGGATATACCACCGTTGATATATCCCAATGGC<br>ATCGTAAAGAACATTTTGAGGCATTTCAGTCAGTTGCTCAATGTACCTATAACCAGACCGTTCAGCTGGATATTACGGCCTTTTTAAAGA<br>CCGTAAAGAAAAATAAGCACAAGTTTTATCCGGCCTTTATTCACATTCTTGCCCGCCTGATGAATGCTCATCCGGAATTCCGTATGGCAA<br>TGAAAGACGGTGAGCTGGTGATATGGGATAGTGTTCACCCTTGTTACACCGTTTTCCATGAGCAAACTGAAACGTTTTCATCGCTCTGG<br>AGTGAATACCACGACGATTTCCGGCAGTTTCTACACATATATTCGCAAGATGTGGCGTGTTACGGTGAAAACCTGGCCTATTTCCCTAAA<br>GGGTTTATTGAGAATATGTTTTCGTCTCAGCCAATCCCTGGGTGAGTTTCACCAGTTTTGATTTAAACGTGGCCAATATGGACAACTTC<br>TTCGCCCCCGTTTTCACCATGGGCAAATATTATACGCAAGGCGACAAGGTGCTGATGCCGCTGGCGATTCAGGTTCATCATGCCGTCT |

TABLE 9-PC-continued

| Target ID | Hairpin Sequence 5' → 3' |
|---|---|
| | GTGATGGCTTCCATGTCGGCAGAATGCTTAATGAATTACAACAGTACTGCGATGAGTGGCAGGGCGGGGCGTAAACGCGTGGATCAGC<br>TTAATATGACTCTCAATAAAGTCTCATACCAACAAGTGCCACCTTATTCAACCATCAAGAAAAAAGCCAAAATTTATGCTACTCTAAGGAA<br>AACTTCACTAAAGAAGACGATTTAGAGTGTTTTACCAAGAATTTCTGTCATCTTACTAAACAACTAAAGATCGGTGTGATACAAAACCTAA<br>TCTCATTAAAGTTTATGCTAAAATAAGCATAATTTTACCCACTAAGCGTGACCAGATAAACATAACTCAGCACACCAGAGCATATATATTG<br>GTGGCTCAAATCATAGAAACTTACAGTGAAGACACAGAAAGCGTAAGAAGAGGCAAGAGTATGAAACCTTACCTCATCATTTCCATGA<br>GGTTGCTTCTGATCCCGCGGGATATCACCACTTTGTACAAGAAAGCTGGGTCGAATTCGCCCTTCGGATCTCGGGCACCAATTGCTGA<br>GCGATCAGATCCAACCTAGCCTCCATCGTGTTGCTGATCTTGATCTTGTTCTTCTGAGCGAGCAGATCGACGCCTCCGGTGATCTCCTG<br>AGACAGGTGCGACTCATCGTCCACCTTGAGTAGGATGTCTTTGCCGGTGGCGTCCTTGTATTTGGCAGCGACGTTGGGCAGGATGGAC<br>CTAACCAAGTCCCTATCTTGCGGTCTCACGCGGACCGTCACCTCCTTCTCGAACAGCTGGAACAGTCCTTGTAGGATTAGGCTCTCCAA<br>AATTTGGGAGTATTTTCCTTGGTCTTTGGTTACTTCACCAAGACTTTTACGAGCATCCTCCAGGACTGCTCTGACATGGTCCTCTCTCAC<br>TTTCAGCACCTTCAAACGAGCCTGATTCAACATATTAGAGGACTGAATTTTCTTTTGAAGTTCGACTTGCTTCTCCTTTTTCTCGTAGTAC<br>TCCATGATCTTGAGTCTCTGTTGCTGGACTAAACGCCCTTTTTCAATGTTGAATTCCTCCTCTGCCTTGGCATCGATTTCTTCTGCTTTCT<br>CATTGGCTTCTTGTTCAATGAAAGCCATCATATGTTTGATCTGCG |
| PC016 | SEQ ID NO: 511<br>TTGGGCATAGTCAAGATGGGGATCTGCGTGATGGAGCCGTTGCGGCCCTCCACACGACCGGCGCGCTCGTAAATGGTGGCCAGATCG<br>GTGTACATGTAACCGGGGAAACCCCTACGGCCGGGCACTTCTTCTCGAGCGGCAGACACCTCACGCAACGCCTCCGCGTACGACGAC<br>ATGTCGGTCAAGATGACCAGCACGTGCTTCTCGCACTGGTAGGCCAAGAATTCGGCGGCCGTCAGAGCCAAACGCGGCGTGATGATG<br>CGCTCGATGGTCGGATCGTTGGCCAAGTTCAAGAACAGACACACGTTCTCCATCGAGCCGTTCTCTTCGAAGTCCTGCTTGAAGAACCT<br>GGCAGTTTCCATGTTGACACCCATAGCAGCAAACACAATAGCAAAGTTGTCTTCATGGTCATCCAGCACAGACTTGCCAGGTACTTTGA<br>CCAAGCCAGCCTGCCTACAAATCTGGGCTGCAATCTCATTGTGGGGCAGCCCAGCGGCGGAGAAGATCGGAATCTTCTGCCCCTCTGG<br>CGATAGAGTTCATCACGTCGATGGCCGTGATCCCAGTCTGGATCATTTCCTCGGGATAAATACGCGACCACGGGTTGATCGGCTGTCC<br>TTGGATGTCGAGGTAGTCCTCAGCCAGGATCGGGGGACCCTTTATCAATGGGTTTTCCTGATCCATTGAAGACACGTCCCAGCATATCTT<br>CTGATACTGGAGTTCTTAGAATATCTCCAGTGAACTCACACACCGTGTTCTTAGCATCAATACCTGATGTGCCTTCAAATACCTGAACAA<br>CTGCCTTTGATCCACTGACTTCCAAAACTTGTCCAGATCGTAGAGTTCCATCTGCCAATTTGAGCTGGACAATTTCATTGAATTTTGGAA<br>ACTTGACATCCTCAAGAATGACCAGTAAGGGCGAATTCGACCCAGCTTCTTGTACAAAGTGGTGATATCACTAGTGCGGCCGCCTGCA<br>GGTCGACCCATATGGTCGACCTGCAGGCGGCCGCACTAGTGATGCTGTTATGTTCAGTGTCAAGCTGACCTGCAAACACGTTAAATGCT<br>AAGAAGTTAGAATATATGAGACACGTTAACTGGTATATGAATAAGCTGTAAATAACCGAGTATAAACTCATTAACTAATATCACCTCTAGA<br>GTATAATATAATCAAATTCGACAATTTGACTTTCAAGAGTAGGCTAATGTAAAATCTTTATATATTTCTACAATGTTCAAAGAAACAGTTGC<br>ATCTAAACCCCTATGGCCATCAAATTCAATGAACGCTAAGCTGATCCGGCGAGATTTTCAGGAGCTAAGGAAGCTAAAATGGAGAAAAA<br>AATCACTGGATATACCACCGTTGATATATCCCAATGGCATCGTAAAGAACATTTTGAGGCATTTCAGTCAGTTGCTCAATGTACCTATAA<br>CCAGACCGTTCAGCTGGATATTACGGCCTTTTTAAAGACCGTAAAGAAAATAAGCACAAGTTTTATCCGGCCTTTATTCACATTCTTGC<br>CCGCCTGATGAATGCTCATCCGGAATTCCGTATGGCAATGAAAGACGGTGAGCTGGTGATATGGGATAGTGTTCACCCTTGTTACACC<br>GTTTTCCATGAGCAAACTGAAACGTTTTCATCGCTCTGGAGTGAATACCACGACGATTTCCGGCAGTTTCTACACATATATTCGCAAGAT<br>GTGGCGTGTTACGGTGAAAACCTGGCCTATTTCCCTAAAGGGTTTATTGAGAATATGTTTTTCGTCTCAGCCAATCCTGGGTGAGTTTC<br>ACCAGTTTTGATTTAAACGTGGCCAATATGGACAACTTCTTCGCCCCCGTTTTCACCATGGGCAAATATTATACGCAAGGCGACAAGGT<br>GCTGATGCCGCTGGCGATTCAGGTTCATCATGCCGTCTGTGATGGCTTCCATGTCGGCAGAATGCTTAATGAATTACAACAGTACTGCG<br>ATGAGTGGCAGGGCGGGGCGTAAACGCGTGGATCAGCTTAATATGACTCTCAATAAAGTCTCATACCAACAAGTGCCACCTTATTCAAC<br>CATCAAGAAAAAAGCCAAAATTTATGCTACTCTAAGGAAAACTTCACTAAAGAAGACGATTTAGAGTGTTTTACCAAGAATTTCTGTCATC<br>TTACTAAACAACTAAAGATCGGTGTGATACAAAACCTAATCTCATTAAAGTTTATGCTAAAATAAGCATAATTTTACCCACTAAGCGTGAC<br>CAGATAAACATAACTCAGCACACCAGAGCATATATATTGGTGGCTCAAATCATAGAAACTTACAGTGAAGACACAGAAAGCCGTAAGAA<br>GAGGCAAGAGTATGAAACCTTACCTCATCATTTCCATGAGGTTGCTTCTGATCCCGCGGGATATCACCACTTTGTACAAGAAAGCTGGG<br>TCGAATTCGCCCTTACTGCTCATTCTTGAGGATGTCAAGTTTCCAAAATTGACATTGGCCAGTTGCAGATGGAACTCTA<br>CGATCTGGACAAGTTTTGGAAGTCAGTGGATCAAAGGCAGTTGTTCAGGTATTTGAAGGCACATCAGGTATTGATGCTAAGAACACGGT<br>GTGTGAGTTCACTGGAGATATTCTAAGAACTCCAGTATCAGAAGATATGCTGGGACGTGTCTTCAATGGATCAGGAAAACCCATTGATA<br>AAGGTCCCCCGATCCTGGCTGAGGACTACCTCGACATCCAAGGACAGCCGATCAACCCGTGGTCGCGTATTTATCCCGAGGGAAATGAT<br>CCAGACTGGGATCACGGCCATCGACGTGATGAACTCTATCGCCAGAGGGCAGAAGATTCCGATCTTCTCCGCCGCTGGGCTGCCCCA<br>CAATGAGATTGCAGCCCAGATTTGTAGGCAGGCTGGCTTGGTCAAAGTACCTGGCAAGTCTGTGCTGGATGACCATGAAGCAACTTT<br>GCTATTGTGTTTGCTGCTATGGGTGTCAACATGGAAACTGCCAGGTTCTTCAAGCAGGACTTCGAAGAGAACGGCTGATGGAGAACG<br>TGTGTCTGTTCTTGAACTTGGCCAACGATCCGACCATCGAGCGCATCATCACGCCGCGTTTGGCTCTGACGGCCGCCGAATTCTTGGC<br>CTACCAGTCGAGAAGCACGTGCTGGTCATCTTGACCGACATGTCGTCGTACGCGGAGGCGTTGCGTGAGGTGTCTGCCGCTCGAGA<br>AGAAGTGCCCGGCCGTAGGGGTTTCCCCGGTTACATGTACACCGATCTGGCCACCATTTACGAGCGCGCCGGTCGTGTGGAGGGCCG<br>CAACGGCTCCATCACGCAGATCCCCATCTTGACTATGCCCAA |
| PC027 | SEQ ID NO: 512<br>GGGCCAAGCACAGCGAAATGCAGCAAGCTAACTTGAAAGCACTACCAGAAGGAGCTGAAATCAGAGATGGAGAACGTTTGCCAGTCAC<br>AGTAAAGGACATGGGAGCATGCGAGATTTACCCACAAACAATCCAACACAACCCCAATGGGCGGTTTGTAGTGGTTTGTGGTGATGGA<br>GAATACATAATATACACGGCTATGGCCCTTCGTAACAAAGCATTTGGTAGCGCTCAAGAATTTGTATGGGCACAGGACTCCAGTGAATA<br>TGCCATCCGCGAATCCGGATCCACCATTCGAATCTTCAAGAATTTCAAAGAAAAAAGGAATTTCAAGTCCGACTTTGGTGCCGAAGGAAT<br>CTATGGTGGTTTTCTCTTGGGTGTGAAATCAGTGTCTGGCTTAGCTTTCTATGACTGGGAAACGCTTGAGTTAGTAAGGCGCATTGAAAT<br>ACAGCCTAGAGCTATCTACTGGTCAGATAGTGGCAAGTTGGTATGCCTTGCTACCGAAGATAGCTATTTCATATTGTCCTATGACTCTGA<br>CCAAGTCCAGAAAGCTAGAGATAACAACCAAGTTGCCGAAGATGAGTGGAGGCTGCCTTTGATGTCCTAGGTGAAATAAATGAATCC<br>GTAAGAACAGGTCTTTGGGTAGGAGACTGCTTCATTTACACAAACGCAGTCAACCGTATCAACTACTTTGTGGGTGGTGAATTGGTAAC<br>TATTGCACATCTGGACCGTCCTCTATATGTCCTGGGCTATCTAGAGATGACAGGTTATACTTGGTTGATAAAGAGTTAGGAGTAGT<br>CAGCTATCAATTGCTATTATCTGTACTCGAATATCGACTGCAGTCATGCGACGAGACTTCCCAACGGCTGATCGAGTATTGCCTTCAAT<br>TCCAAAAGAACACCGCACTAGGGTGGCACAAAGGGCGAATTCGACCCAGCTTCTTGTACAAAGTGGTGATATCACTAGTGCGGCCGC<br>CTGCAGGTCGACCCATATGGTCGACCTGCAGGCGGCCGCACTAGTGATGCTGTTATGTTCAGTGTCAAGCTGACCTGCAAACACGTTAA<br>ATGCTAAGAAGTTAGAATATATGAGACACGTTAACTGGTATATGAATAAGCTGTAAATAACCGAGTATAAACTCATTAACTAATATCACCT<br>CTAGAGTATAATATAATCAAATTCGACAATTTGACTTTCAAGAGTAGGCTAATGTAAAATCTTTATATATTTCTACAATGTTCAAAGAAACA<br>GTTGCATCTAAACCCCTATGGCCATCAAATTCAATGAACGCTAAGCTGATCCGGCGAGATTTTCAGGAGCTAAGGAAGCTAAAATGGAG<br>AAAAAAATCACTGGATATACCACCGTTGATATATCCCAATGGCATCGTAAAGAACATTTTGAGGCATTTCAGTCAGTTGCTCAATGTACC<br>TATAACCAGACCGTTCAGCTGGATATTACGGCCTTTTTAAAGACCGTAAAGAAAATAAGCACAAGTTTTATCCGGCCTTTATTCACATTC<br>TTGCCCGCCTGATGAATGCTCATCCGGAATTCCGTATGGCAATGAAAGACGGTGAGCTGGTGATATGGGATAGTGTTCACCCTTGTTAC<br>ACCGTTTTCCATGAGCAAACTGAAACGTTTTCATCGCTCTGGAGTGAATACCACGACGATTTCCGGCAGTTTCTACACATATATTCGCAA<br>GATGTGGCGTGTTACGGTGAAAACCTGGCCTATTTCCCTAAAGGGTTTATTGAGAATATGTTTTTCGTCTCAGCCAATCCTGGGTGAG<br>TTTCACCAGTTTTGATTTAAACGTGGCCAATATGGACAACTTCTTCGCCCCCGTTTTCACCATGGGCAAATATTATACGCAAGGCGACAA<br>GGTGCTGATGCCGCTGGCGATTCAGGTTCATCATGCCGTCTGTGATGGCTTCCATGTCGGCAGAATGCTTAATGAATTACAACAGTACT |

TABLE 9-PC-continued

| Target ID | Hairpin Sequence 5' → 3' |
|---|---|
| | GCGATGAGTGGCAGGGCGGGGCGTAAACGCGTGGATCAGCTTAATATGACTCTCAATAAAGTCTCATACCAACAAGTGCCACCTTATT
CAACCATCAAGAAAAAAGCCAAATTTATGCTACTCTAAGGAAAACTTCACTAAAGAAGACGATTTAGAGTGTTTTACCAAGAATTTCTGT
CATCTTACTAAACAACTAAAGATCGGTGTGATACAAAACCTAATCTCATTAAAGTTTATGCTAAAATAAGCATAATTTTACCCACTAAGCG
TGACCAGATAAACATAACTCAGCACACCAGAGCATATATATTGGTGGCTCAAATCATAGAAACTTACAGTGAAGACACAGAAAGCCGTAA
GAAGAGGCAAGAGTATGAAACCTTACCTCATCATTTCCATGAGGTTGCTTCTGATCCCGCGGGATATCACCACTTTGTACAAGAAAGCT
GGGTCGAATTCGCCCTTTGTGCCACCCTAGTGCGGTGTTCTTTTGGAATTGAAGGCAATACTCGATCAGCCGTTGGGAAGTCTCGTCG
CATGACTGCAGTCTGATATTCGAGTACAGATAATAGCAATTGATAGCTGACTACTCCTAACTCTTTATCAACCAAGTATAACCTGTCATCT
CTAGGTACATAGCCCAGGACATATAGAGGACGGTCCAGATGTGCAATAGTTACCAATTCACCACCCACAAAGTAGTTGATACGGTTGAC
TGCGTTTGTGTAAATGAAGCAGTCTCCTACCCAAAGACCTGTTCTTACGGATTCATTTATTTCACCTAGGACATCAAAGGCAGCCTCCAC
TCCATCTTCGGCAACTTGGTTGTTATCTCTAGCTTTCTGGACTTGGTCAGAGTCATAGGACAATATGAAATAGCTATCTTCGGTAGCAAG
GCATACCAACTTGCCACTATCTGACCAGTAGATAGCTCTAGGCTGTATTTCAATGCGCCTTACTAACTCAAGCGTTTCCCAGTCATAGAA
AGCTAAGCCAGACACTGATTTCACACCCAAGAGAAAACCACCATAGATTCCTTCGGCACCAAAGTCGGACTTGAAATTCTTTTTTTCTTT
GAAATTCTTGAAGATTCGAATGGTGGATCCGGATTCGCCGATGGCATATTCACTGGAGTCCTGTGCCCATACAAATTCTTGAGCGCTAC
CAAATGCTTTGTTACGAAGGGCCATAGCCGTGTATATTATGTATTCTCCATCACCACAAACCACTACAAACCGCCCATTGGGGTTGTGTT
GGATTGTTTGTGGGTAAATCTCGCATGCTCCCATGTCCTTTACTGTGACTGGCAAACGTTCTCCATCTCTGATTTCAGCTCCTTCTGGTA
GTGCTTTCAAGTTAGCTTGCTGCATTTCGCTGTGCTTGGCCC |

TABLE 9-MP

| Target ID | Hairpin Sequence 5' → 3' |
|---|---|
| MP001 | SEQ ID NO: 1066
GTTTAAACGCACCCAAAGCATGGATGTTGGACAAATCGGGGGGTGTCTTCGCTCCACGTCCAAGCACCGGTCCACACAAACTTCGTG
AATCACTACCGTTATTGATCTTCTTGCGTAATCGTTTGAAGTATGCACTTACTGGTGCCGAAGTCACCAAGATTGTCATGCAAAGATTA
ATCAAGGTTGATGGCAAAGTCCGTACCGACCCTAATTATCCAGCCGGTTTTATGGATGTTATATCTATCCAAAAGACCAGTGAGCACT
TTAGATTGATCTATGATGTGAAAGGTCGTTTCACCATCCACAGAATTACTCCTGAAGAAGCAAAATACAAGTTGTGTAAAGTAAAGAGG
GTACAAACTGGACCCAAAGGTGTGCCATTTTTAACTACTCAGATGATGGCCGTACTATTCGCTACCCTGACCCTAACATCAAGGTTAATG
ACACTATTAGATACGATATTGCATCATCTAAAATTTTGGATCATATCCGTTTTGAAACTGGAAACTTGTCATGATAACTGGAGGTCGC
AATTTAGGGCGTGTTGGTATTGAAGGGCGAATTCGACCCAGCTTCTTGTACAAAGTGGTGATATCACTAGTGCGGCCGCCTGCAGG
TCGACCCATATGGTCGACCTGCAGGCGGCCGCACTAGTGATGCTGTTATGTTCAGTGTCAAGCTGACCTGCAAACACGTTAAATGCTA
AGAAGTTAGAATATATGAGACACGTTAACTGGTATATGAATAACCAGATAAACTCATTAACTAATATATCACCTCTAGA
GTATAATATAATCAAATTCGACAATTTGACTTTCAAGAGTAGGCTAATGTAAAATCTTTATATATTTCTACAATGTTCAAAGAAACAGTTG
CATCTAAACCCCTATGGCCATCAAATTCAATGAACGCTAAGCTGATCCGGCGAGATTTTCAGGAGCTAAGGAAGCTAAAATGGAGAAA
AAAATCACTGGATATACCACCGTTGATATATCCCAATGGCATCGTAAAGAACATTTTGAGGCATTTCAGTCAGTTGCTCAATGTACCTA
TAACCAGACCGTTCAGCTGGATATTACGGCCTTTTAAAGACCGTAAAGAAAATAAGCACAAGTTTTATCATTAACTAATAATATCACATTC
TTGCCCGCCTGATGAATGCTCATCCGGAATTCCGTATGGCAATGAAAGACGGTGAGCTGGTGATATGGGATAGTGTTCACCCTTGTT
ACACCGTTTTCCATGAGCAAACTGAAACGTTTTCATCGCTCTGGAGTGAATACCACGACGATTTCCGGCAGTTTCTACACATATATTCG
CAAGATGTGGCGTGTTACGGTGAAAACCTGGCCTATTTCCCTAAAGGGTTTATTGAGAATATGTTTTTCGTCTCAGCCAATCCCTGGG
TGAGTTTCACCAGTTTTGATTTAAACGTGGCCAATATGGACAACTTCTTCGCCCCCGTTTTCACCATGGGCAAATATTATACGCAAGGC
GACAAGGTGCTGATGCCGCTGGCGATTCAGGTTCATCATGCCGTCTGTGATGGCTTCCATGTCGGCAGAATGCTTAATGAATTACAA
CAGTACTGCGATGAGTGGCAGGGCGGGGCGTAAACGCGTGGATCAGCTTAATATGACTCTCAATAAAGTCTCATACCAACAAGTGCC
ACCTTATTCAACCATCAAGAAAAAAGCCAAATTTATGCTACTCTAAGGAAAACTTCACTAAAGAAGACGATTTAGAGTGTTTTACCAA
GAATTTCTGTCATCTTACTAAACAACTAAAGATCGGTGTGATACAAAACCTAATCTCATTAAAGTTTATGCTAAAATAAGCATAATTTTAC
CCACTAAGCGTGACCAGATAAACATAACTCAGCACACCAGAGCATATATATTGGTGGCTCAAATCATAGAAACTTACAGTGAAGACAC
AGAAAGCCGTAAGAAGAGGCAAGAGTATGAAACCTTACCTCATCATTTCCATGAGGTTGCTTCTGATCCCGCGGGATATCACCACTTT
GTACAAGAAAGCTGGGTCGAATTCGCCCTTCAATACCAACACGCCCTAAATTGCGACCTCCAGTTATCATGCACAAGTTTCCAGTTTC
AAAACGGATATGATCCAAAATTTTAGATGATGCAATATCGTATCTAATAGTGTCATTAACCTTGATGTTAGGGTCAGGGTAGCGAATAG
TACGGCCATCATGAGTAGTTAAAAATGGCACACCTTTGGGTCCAGTTTGTACCCTCTTTTACTTTACACACTTGTATTTTGCTTCTTCA
GGAGTAATTCTGTGGATGGTGAAACGACCTTTCACATCATAGATCAATCTAAAGTGCTCACTGGTCTTTTGGATAGATATAACATCCAT
AAAACCGGCTGGATAATTAGGGTCGGTACGGACTTTGCCATCAACCTTGATTAATCTTTGCATGACAATCTTGGTGACTTCGGCACCA
GTAAGTGCATACTTCAAACGATTACGCAAGAAGATCAATAACGGTAGTGATTCACGAAGTTTGTGTGGACCGGTGCTTGGACGTGGA
GCGAAGACACCCCCGATTTGTCCAACATCCATGCTTTGGGTGCGTTTAAAC |
| MP002 | SEQ ID NO: 1067
GCTGATTTAAGTGCATCTGCTGCAGTTTTCATGGTAGTCAATACTGCTGTATTTGTGTTGGCACCTTCTAATGCCTCCCGCTGTTGTTC
AATAGTTAACATGGTACCATCAATTTGGGCTAATTGTTGTTGACCGTTTCTTACGCTTCAATGCTTGCAATGCAGCTCGTTTATTAGT
TGTACCATTTTTTTGGCTATCGCTACTTCTTGTTCAATTTTTTTTCTAAAAATTCTTGTTTCTTTATCAGCATCTCTTCAGTGGATCGAA
GCTTTTGTATCGCATCTTCGGTTGATGGTCCCTTCTCTTCCTTTTTGCCACCAAGGGCGAATTCGACCCAGCTTCTTGTACAAAGTG
GTGATATCACTAGTGCGGCCGCCTGCAGGTCGACCCATATGGTCGACCTGCAGGCGGCCGCACTAGTGATGCTGTTATGTTCAGTGT
CAAGCTGACCTGCAAACACGTTAAATGCTAAGAAGTTAGAATATATGAGACACGTTAACTGGTATATGAATAACCAGATAAACTCGAG
TATAAACTCATTAACTAATATCACCTCTAGAGTATAATATAATCAAATTCGACAATTTGACTTTCAAGAGTAGGCTAATGTAAAATCTTTA
TATTTCTACAATGTTCAAAGAAACAGTTGCATCTAAACCCCTATGGCCATCAAATTCAATGAACGCTAAGCTGATCCGGCGAGATTTT
TCAGGAGCTAAGGAAGCTAAAATGGAGAAAAAAATCACTGGATATACCACCGTTGATATATCCCAATGGCATCGTAAAGAACATTTTG
AGGCATTTCAGTCAGTTGCTCAATGTACCTATAACCAGACCGTTCAGCTGGATATTACGGCCTTTTAAAGACCGTAAAGAAAAATAAG
CACAAGTTTTATCCGGCCTTTATTCACATTCTTGCCCGCCTGATGAATGCTCATCCGGAATTCCGTATGGCAATGAAAGACGGTGAGC
TGGTGATATGGGATAGTGTTCACCCTTGTTACACCGTTTTCCATGAGCAAACTGAAACGTTTTCATCGCTCTGGAGTGAATACCACGA
CGATTTCCGGCAGTTTCTACACATATATTCGCAAGATGTGGCGTGTTACGGTGAAAACCTGGCCTATTTCCCTAAAGGGTTTATTGAG
AATATGTTTTTCGTCTCAGCCAATCCCTGGGTGAGTTTCACCAGTTTTGATTTAAACGTGGCCAATATGGACAACTTCTTCGCCCCCGT
TTTCACCATGGGCAAATATTATACGCAAGGCGACAAGGTGCTGATGCCGCTGGCGATTCAGGTTCATCATGCCGTCTGTGATGGCTT
CCATGTCGGCAGAATGCTTAATGAATTACAACAGTACTGCGATGAGTGGCAGGGCGGGGCGTAAACGCGTGGATCAGCTTAATATGA
CTCTCAATAAAGTCTCATACCAACAAGTGCCACCTTATTCAACCATCAAGAAAAAAGCCAAATTTATGCTACTCTAAGGAAAACTTCA
CTAAAGAAGACGATTTAGAGTGTTTTACCAAGAATTTCTGTCATCTTACTAAACAACTAAAGATCGGTGTGATACAAAACCTAATCTCAT
TAAAGTTTATGCTAAAATAAGCATAATTTTACCCACTAAGCGTGACCAGATAAACATAACTCAGCACACCAGAGCATATATATTGGTGG |

TABLE 9-MP-continued

| Target ID | Hairpin Sequence 5' → 3' |
|---|---|
| | CTCAAATCATAGAAACTTACAGTGAAGACACAGAAAGCCGTAAGAAGAGGCAAGAGTATGAAACCTTACCTCATCATTTCCATGAGGT<br>TGCTTCTGATCCCGCGGGATATCACCACTTTGTACAAGAAAGCTGGGTCGAATTCGCCCTTGGTGGCAAAAAGGAAGAGAAGGGACC<br>ATCAACCGAAGATGCGATACAAAAGCTTCGATCCACTGAAGAGATGCTGATAAAGAAACAAGAATTTTTAGAAAAAAAAATTGAACAAG<br>AAGTAGCGATAGCCAAAAAAATGGTACAACTAATAAACGAGCTGCATTGCAAGCATTGAAGCGTAAGAAACGGTACGAACAACAATT<br>AGCCCAAATTGATGGTACCATGTTAACTATTGAACAACAGCGGGAGGCATTAGAAGGTGCCAACACAAATACAGCAGTATTGACTACC<br>ATGAAAACTGCAGCAGATGCACTTAAATCAGC |
| MP010 | SEQ ID NO: 1068<br>CAGACCCTGTTCAGAATATGATGCATGTTAGTGCTGCATTTGATCAAGAAGCATCTGCCGTTTTAATGGCTCGTATGGTAGTGAACCG<br>TGCTGAAACTGAGGATAGTCCAGATGTGATGCGTTGGGCTGATCGTACGCTTATACGCTTGTGTCAAAAATTTGGTGATTATCAAAA<br>GATGATCCAAATAGTTTCCGATTGCCAGAAAACTTCAGTTTATATCCACAGTTCATGTATCATTTAAGAAGGTCTCAATTTCTACAAGTT<br>TTTAATAATAGTCCTGATGAAACATCATATTATAGGCACATGTTGATGCGTGAAGATGTTACCCAAAGTTTAATCATGATACAGCCAATT<br>CTGTATAGCTATAGTTTTAATGGTAGGCCAGAACCTGTACTTTTGGATACCAGTAGTATTCAACCTGATAAAATATTATTGATGGACAC<br>ATTTTTCCATATTTTGATATTCCATGGAGAGACTATTGCTCAATGGAGAGCAATTGGATTATCAAAATAGACCAGAGTATAGTAACCTCA<br>AGCAGTTGCTTCAAGCCCCCGTTGATGATGCTCAGGAAATTCTCAAAACTCGATTCCCAATGCAAGGGCGAATTCGACCCAGCTTTCT<br>TGTACAAAGTGGTGATATCACTAGTGCGGCCGCCTGCAGGTCGACCCATATGGTCGACCTGCAGGCGGCCGCACTAGTGATGCTGTT<br>ATGTTCAGTGTCAAGCTGACCTGCAAACACGTTAAATGCTAAGAAGTTAGAATATATGAGACACGTTAACTGGTATATGAATAAGCTGT<br>AAATAACCGAGTATAAACTCATTAACTAATATCACCTCTAGAGTATAATATAATCAAATTCGACAATTTGACTTTCAAGAGTAGGCTAAT<br>GTAAAATCTTTATATATTTCTACAATGTTCAAAGAAACAGTTGCATCTAAACCCCTATGGCCATCAAATTCAATGAACGCTAAGCTGATC<br>CGGCGAGATTTTCAGGAGCTAAGGAAGCTAAAATGGAGAAAAAAATCACTGGATATACCACCGTTGATATATCCCAATGGCATCGTAA<br>AGAACATTTTGAGGCATTTCAGTCAGTTGCTCAATGTACCTATAACCAGACCGTTCAGCTGGATATTACGGCCTTTTTAAAGACCGTAA<br>AGAAAAATAAGCACAAGTTTTATCCGGCCTTTATTCACATTCTTGCCCGCCTGATGAATGCTCATCCGGAATTCCGTATGGCAATGAAA<br>GACGGTGAGCTGGTGATATGGGATAGTGTTCACCCTTGTTACACCGTTTTCCATGAGCAAACTGAAACGTTTTCATCGCTCTGGAGTG<br>AATACCACGACGATTTCCGGCAGTTTCTACACATATATTCGCAAGATGTGGCGTGTTACGGTGAAAACCTGGCCTATTTCCCTAAAGG<br>GTTTATTGAGAATATGTTTTTCGTCTCAGCCAATCCCTGGGTGAGTTTCACCAGTTTTGATTTAAACGTGGCCAATATGGACAACTTCT<br>TCGCCCCCGTTTTCACCATGGGCAAATATTATACGCAAGGCGACAAGGTGCTGATGCCGCTGGCGATTCAGGTTCATCATGCCGTCT<br>GTGATGGCTTCCATGTCGGCAGAATGCTTAATGAATTACAACAGTACTGCGATGAGTGGCAGGGCGGGCGTAAACGCGTGGATCA<br>GCTTAATATGACTCTCAATAAAGTCTCATACCAACAAGTGCCACCTTATTCAACCATCAAGAAAAAAGCCAAAATTTATGCTACTCTAAG<br>GAAAACTTCACTAAAGAAGACGATTTAGAGTGTTTTACCAAGAATTTCTGTCATCTTACTAAACAACTAAAGATCGGTGTGATACAAAA<br>CCTAATCTCATTAAAGTTTATGCTAAAATAAGCATAATTTTACCCACTAAGCGTGACCAGATAAACATAACTCAGCACACCAGAGCATA<br>TATATTGGTGGCTCAAATCATAGAAACTTACAGTGAAGACACAGAAAGCCGTAAGAAGAGGCAAGAGTATGAAACCTTACCTCATCAT<br>TTCCATGAGGTTGCTTCTGATCCCGCGGGATATCACCACTTTGTACAAGAAAGCTGGGTCGAATTCGCCCTTGCATTGGGAATCGAG<br>TTTTGAGAATTTCCTGAGCATCATCAACGGGGGCTTGAAGCAACTGCTTGAGGTTACTATACTCTGGTCTATTTTGATAATCCATTGCT<br>CTCCATTGAGCAATAGTCTCTCCATGGAATATCAAAATATGGAAAATGTGTCCATCAATAATATTTTATCAGGTTGAATACTACTGGTA<br>TCCAAAAGTACAGGTTCTGGCCTACCATTAAAACTATAGCTATACAGAATTGGCTGTATCATGATTAAACTTTGGGTAACATCTTCACG<br>CATCAACATGTGCCTATAATATGATGTTTCATCAGGACTATTATTAAAAACTTGTAGAAATTGAGACCTTCTTAAATGATACATGAACTG<br>TGGATATAAACTGAAGTTTTCTGGCAATCGGAAACTATTTGGATCATCTTTTTGATAATCACCAAATTTTTGACACAAGCGTATAAGCGT<br>ACGATCAGCCCAACGCATCACATCTGGACTATCCTCAGTTTCAGCACGGTTCACTACCATACGAGCCATTAAAACGGCAGATGCTTCT<br>TGATCAAATGCAGCACTAACATGCATCATATTCTGAACAGGGTCTG |
| MP016 | SEQ ID NO: 1069<br>GTTTTCAATGGCAGTGGAAAGCCGATAGATAAAGGACCTCCTATTTTGGCTGAAGATTATTTGGATATTGAAGGCCAACCTATTAATCC<br>ATACTCCAGAACATATCTCAAGAAATGATTCAAACTGGTATTTCAGCTATTGATAATCATGAACTCTATTGCTCGTGGACAAAAATTCC<br>AATATTTTCAGCTGCAGGTTTACCACATAATGAGATTGCTGCTCAAATTTGTAGACAAGCTGGTCTCGTTAAAAAACCTGGTAAATCAG<br>TTCTTGACGATCATGAAGCAATTTTGCTATAGTATTTGCTGCTATGGGTGTTAATATGGAAACAGCCAGATTCTTTAAACAAGATTTTG<br>AGGAAAATGGTTCAATGGAGAATGTTTGTTTGTTCTTGAATTTAGCTAATGATCCTACTATTGAGCGTATCATTACACCACGAAGGGCG<br>AATTCGACCCAGCTTTCTTGTACAAAGTGGTGATATCACTAGTGCGGCCGCCTGCAGGTCGACCATATGGTCGACCTGCAGGCGGCC<br>GCACTAGTGATGCTGTTATGTTCAGTGTCAAGCTGACCTGCAAACACGTTAAATGCTAAGAAGTTAGAATATATGAGACACGTTAACT<br>GGTATATGAATAAGCTGTAAATAACCGAGTATAAACTCATTAACTAATATCACCTCTAGAGTATAATATAATCAAATTCGACAATTTGAC<br>TTTCAAGAGTAGGCTAATGTAAAATCTTTATATATTTCTACAATGTTCAAAGAAACAGTTGCATCTAAACCCCTATGGCCATCAAATTCA<br>ATGAACGCTAAGCTGATCCGGCGAGATTTTCAGGAGCTAAGGAAGCTAAAATGGAGAAAAAATCACTGGATATACCACCGTTGATAT<br>ATCCCAATGGCATCGTAAAGAACATTTTGAGGCATTTCAGTCAGTTGCTCAATGTACCTATAACCAGACCGTTCAGCTGGATATTACG<br>GCCTTTTTAAAGACCGTAAAGAAAAATAAGCACAAGTTTATCCGGCCTTTATTCACATTCTTGCCCGCCTGATGAATGCTCATCCGGA<br>ATTCCGTATGGCAATGAAAGACGGTGAGCTGGTGATATGGGATAGTGTTCACCCTTGTTACACCGTTTTCCATGAGCAAACTGAAACG<br>TTTTCATCGCTCTGGAGTGAATACCACGACGATTTCCGGCAGTTTCTACACATATATTCGCAAGATGTGGCGTGTTACGGTGAAAACC<br>TGGCCTATTTCCCTAAAGGGTTTATTGAGAATATGTTTTTCGTCTCAGCCAATCCCTGGGTGAGTTTCACCAGTTTTGATTTAAACGTG<br>GCCAATATGGACAACTTCTTCGCCCCCGTTTTCACCATGGGCAAATATTATACGCAAGGCGACAAGGTGCTGATGCCGCTGGCGATT<br>CAGGTTCATCATGCCGTCTGTGATGGCTTCCATGTCGGCAGAATGCTTAATGAATTACAACAGTACTGCGATGAGTGGCAGGGCGGG<br>GCGTAAACGCGTGGATCAGCTTAATATGACTCTCAATAAAGTCTCATACCAACAAGTGCCACCTTATTCAACCATCAAGAAAAAAGCC<br>AAAATTTATGCTACTCTAAGGAAAACTTCACTAAAGAAGACGATTTAGAGTGTTTTACCAAGAATTTCTGTCATCTTACTAAACAACTAA<br>AGATCGGTGTGATACAAAACCTAATCTCATTAAAGTTTATGCTAAAATAAGCATAATTTTACCCACTAAGCGTGACCAGATAAACATAAC<br>TCAGCACACCAGAGCATATATATTGGTGGCTCAAATCATAGAAACTTACAGTGAAGACACAGAAAGCCGTAAGAAGAGGCAAGAGTAT<br>GAAACCTTACCTCATCATTTCCATGAGGTTGCTTCTGATCCCGCGGGATATCACCACTTTGTACAAGAAAGCTGGGTCGAATTCGCCC<br>TTCGTGGTGTAATGATACGCTCAATGTAGGATCATTAGCTAAGTTCAAGAACAAACAAAACATTCTCCATTGAACATTTTCCTCAAAAT<br>CTTGTTTAAAGAATCTGGCTGTTTCCATATTAACACCCATAGCAGCAAATACTATAGCAAAATTGTCTTCATGATCGTCAAGAACTGATT<br>TACCAGGTTTTTTAACGAGACCAGCTTGTCTACAAATTTGAGCAGCAATCTCATTATGTGGTAAACCTGCAGCTGAAAATATTGGAATT<br>TTTTGTCCACGAGCAATAGAGTTCATGATATCAATAGCTGAAATACCAGTTTGAATCATTTCTTGAGGATATGTTCTGGAGTATGGATT<br>AATAGGTTGGCCTTCAATATCCAAATAATCTTCAGCCAAAATAGGAGGTCCTTTATCTATCGGCTTTCCACTGCCATTGAAAAC |
| MP027 | SEQ ID NO: 1070<br>CCAAAAATACCATCTGCTCCACCTTCTGGTTTAAAAGACTTTTTTCTTTAAAATTTTTAAAAACTTTGATTGTAGAAGAATTTTCTCTAA<br>TGGCATACTCAGAATCAGAAGACCATACAAAATCCTGAGCGGAGCCAAATGCTTTATTACGCAAGGCATTGATGTATATAATATAC<br>TCTCCATCACCCACATACTAGTAAAAATCTACCATTCGGATTATGAGATATTGACTGTGGATAAATTTCACAGTACCCATGTCTTTAACT<br>TGTATTGGTAAACGTTCACCATCTTTGATTTCGGCTCCTTCTGCTTGAAGCATCGCTTTAAGGTTAGCTTGTTGAATTTCACTATGACG<br>TGCCCAAACAATTTTACCCCCATGAACATCCATTGACATTGCTGGCTCTTCACGACCAACTTTAACCATTATACTTCCTTCATCATAACC<br>TAGAGCTACATTATTAGATCCCCGTAAGCAACAGATTGTCCATACACGTTCTAACCCATAGTTTAATGATGATTCTAATCGATAAGTAC<br>CAGAATGCCAAATTCTGACGGTACCATCTTCTGAGCCAGTTAACACGATGGGAAGTTCTGGATGGAAACAAACGAGCAAGGGCGAAT |

TABLE 9-MP-continued

| Target ID | Hairpin Sequence 5' → 3' |
|---|---|
| | TCGACCCAGCTTTCTTGTACAAAGTGGTGATATCACTAGTGCGGCCGCCTGCAGGTCGACCATATGGTCGACCTGCAGGCGGCCGC
ACTAGTGATGCTGTTATGTTCAGTGTCAAGCTGACCTGCAAACACGTTAAATGCTAAGAAGTTAGAATATATGAGACACGTTAACTGGT
ATATGAATAAGCTGTAAATAACCGAGTATAAACTCATTAACTAATATCACCTCTAGAGTATAATATAATCAAATTCGACAATTTGACTTTC
AAGAGTAGGCTAATGTAAAATCTTTATATATTTCTACAATGTTCAAAGAAACAGTTGCATCTAAACCCCTATGGCCATCAAATTCAATGA
ACGCTAACTGATCCGGCGAGATTTTCAGGAGCTAAGGAAGCTAAAATGGAGAAAAAAATCACTGGATATACCACCGTTGATATATCC
AATGGCATCGTAAAGAACATTTTGAGGCATTTCAGTCAGTTGCTCAATGTACCTATAACCAGACCGTTCAGCTGGATATTACGGCCT
TTTTAAAGACCGTAAAGAAAAATAAGCACAAGTTTTATCCGGCCTTTATTCACATTCTTGCCCGCCTGATGAATGCTCATCCGGAATTC
CGTATGGCAATGAAAGACGGTGAGCTGGTGATATGGGATAGTGTTCACCCTTGTTACACCGTTTTCCATGAGCAAACTGAAACGTTTT
CATCGCTCTGGAGTGAATACCACGACGATTTCCGGCAGTTTCTACACATATATTCGCAAGATGTGGCGTGTTACGGTGAAAACCTGG
CCTATTTCCCTAAAGGGTTTATTGAGAATATGTTTTTCGTCTCAGCCAATCCCTGGGTGAGTTTCACCAGTTTTGATTTAAACGTGGCC
AATATGGACAACTTCTTCGCCCCCGTTTTCACCATGGGCAAATATTATACGCAAGGCGACAAGGTGCTGATGCCGCTGGCGATTCAG
GTTCATCATGCCGTCTGTGATGGCTTCCATGTCGGCAGAATGCTTAATGAATTACAACAGTACTGCGATGAGTGGCAGGGCGGGGCG
TAAACGCGTGGATCAGCTTAATATGACTCTCAATAAAGTCTCATACCAACAAGTGCCACCTTATTCAACCATCAAGAAAAAAGCCAAA
TTTATGCTACTCTAAGGAAAACTTCACTAAAGAAGACGATTTAGAGTGTTTTACCAAGAATTTCTGTCATCTTACTAAACAACTAAAGAT
CGGTGTGATACAAAACCTAATCTCATTAAAGTTTATGCTAAAATAAGCATAATTTTACCCACTAAGCGTGACCAGATAAACATAACTCA
GCACACCAGAGCATATATATTGGTGGCTCAAATCATAGAAACTTACAGTGAAGACACAGAAAGCCGTAAGAAGAGGCAAGAGTATGA
AACCTTACCTCATCATTTCCATGAGGTTGCTTCTGATCCCGCGGGATATCACCACTTTGTACAAGAAAGCTGGGTCGAATTCGCCCTT
GCTCGTTTGTTTCCATCCAGAACTTCCCATCGTGTTAACTGGCTCAGAAGATGGTACCGTCAGAATTTGGCATTCTGGTACTTATCGAT
TAGAATCATCATTAAACTATGGGTTAGAACGTGTATGGACAATCTGTTGCTTACGGGGATCTAATAATGTAGCTCTAGGTTATGATGAA
GGAAGTATAATGTTAAAGTTGGTCGTGAAGAGCCAGCAATGTCAATGGATGTTCATGGGGGTAAAATTGTTTGGGCACGTCATAGT
GAAATTCAACAAGCTAACCTTAAAGCGATGCTTCAAGCAGAAGGAGCCGAAATCAAAGATGGTGAACGTTTACCAATACAAGTTAAAG
ACATGGGTAGCTGTGAAATTTATCCACAGTCAATATCTCATAATCCGAATGTGAGATTTTTAGTAGTATGTGGTGATGGAGAGTATATT
ATATATACATCAATGGCTTTGCGTAATAAAGCATTTGGCTCCGCTCAGGATTTTGTATGGTCTTCTGATTCTGAGTATGCCATTAGAGA
AAATTCTTCTACAATCAAAGTTTTTAAAAATTTTAAAGAAAAAAAGTCTTTTAAACCAGAAGGTGGAGCAGATGGTATTTTGG |

TABLES 10-NL (a)

| RNAi | Mean % survival (days post start) | | | | | | | | | Survival analysis[1] |
|---|---|---|---|---|---|---|---|---|---|---|
| | 0 | 1 | 2 | 3 | 4 | 5 | 6 | 7 | 8 | |
| gfp | 100 | 98 | 90 | 82 | 68 | 60 | 44 | 32 | 20 | − |
| diet only | 100 | 98 | 96 | 86 | 74 | 68 | 58 | 54 | 38 | − |
| NL002 | 100 | 98 | 90 | 76 | 68 | 34 | 6 | 0 | 0 | + |
| NL003 | 100 | 98 | 74 | 48 | 36 | 22 | 12 | 2 | 0 | + |
| NL005 | 100 | 100 | 74 | 56 | 40 | 20 | 16 | 6 | 4 | + |
| NL010 | 100 | 96 | 74 | 56 | 48 | 30 | 18 | 12 | 8 | + |

| | Chi squared | P value | Sig. Dif.[2] |
|---|---|---|---|
| diet versus: | | | |
| NL002 | 29.06 | <0.0001 | Yes |
| NL003 | 39.59 | <0.0001 | Yes |
| NL005 | 29.55 | <0.0001 | Yes |
| NL010 | 21.04 | <0.0001 | Yes |
| gfp dsRNA versus: | | | |
| NL002 | 15.09 | 0.0001 | Yes |
| NL003 | 22.87 | <0.0001 | Yes |
| NL005 | 15.12 | <0.0001 | Yes |
| NL010 | 8.838 | 0.0029 | Yes |
| diet versus gfp dsRNA | 4.030 | 0.0447 (~0.05) | No |

[1] = Data were analysed using Kaplan-Meier survival curve analysis
[2] alpha < 0.05

TABLES 10-NL (b)

| RNAi | Mean % survival (days post start) | | | | | | | | | Survival analysis[1] |
|---|---|---|---|---|---|---|---|---|---|---|
| | 0 | 1 | 2 | 3 | 4 | 5 | 6 | 7 | 8 | |
| gfp | 100 | 96 | 84 | 82 | 76 | 70 | 54 | 50 | 44 | − |
| diet only | 100 | 96 | 88 | 82 | 76 | 70 | 54 | 50 | 44 | − |
| NL009 | 100 | 94 | 75 | 63 | 42 | 30 | 24 | 22 | 14 | + |
| NL016 | 100 | 94 | 84 | 78 | 54 | 44 | 36 | 18 | 14 | + |

TABLES 10-NL-continued (b)

| | Chi squared | P value | Sig. Dif.[2] |
|---|---|---|---|
| diet versus: | | | |
| NL009 | 11.98 | 0.0005 | Yes |
| NL016 | 8.98 | 0.0027 | Yes |
| gfp dsRNA versus: | | | |
| NL009 | 13.69 | 0.0002 | Yes |
| NL016 | 11.37 | 0.0007 | Yes |
| diet versus gfp dsRNA | 0.03317 | 0.8555 | No |

[1] = Data were analysed using Kaplan-Meier survival curve analysis
[2] alpha < 0.05

TABLES 10-NL (c)

| RNAi | Mean % survival (days post start) | | | | | | | | | Survival analysis[1] |
|---|---|---|---|---|---|---|---|---|---|---|
| | 0 | 1 | 2 | 3 | 4 | 5 | 6 | 7 | 8 | |
| gfp | 100 | 92 | 84 | 78 | 72 | 62 | 58 | 56 | 48 | − |
| diet only | 100 | 84 | 72 | 68 | 64 | 58 | 52 | 42 | 42 | − |
| NL014 | 100 | 86 | 68 | 60 | 46 | 32 | 24 | 18 | 14 | + |
| NL018 | 100 | 82 | 70 | 54 | 40 | 30 | 18 | 14 | 12 | + |

| | Chi squared | P value | Sig. Dif.[2] |
|---|---|---|---|
| diet versus: | | | |
| NL014 | 8.088 | 0.0045 | Yes |
| NL018 | 10.47 | 0.0012 | Yes |
| gfp dsRNA versus: | | | |
| NL014 | 14.55 | 0.0001 | Yes |
| NL018 | 17.64 | <0.0001 | Yes |
| diet versus gfp dsRNA | 0.6548 | 0.4184 | No |

[1] = Data were analysed using Kaplan-Meier survival curve analysis
[2] alpha < 0.05

TABLES 10-NL (d)

| RNAi | Mean % survival (days post start) | | | | | | | | | | Survival analysis[1] |
|---|---|---|---|---|---|---|---|---|---|---|---|
| | 0 | 1 | 2 | 3 | 4 | 5 | 6 | 7 | 8 | 9 | |
| gfp | 100 | 96 | 84 | 84 | 72 | 68 | 68 | 66 | 66 | 62 | – |
| diet only | 100 | 96 | 86 | 82 | 74 | 72 | 70 | 70 | 66 | 58 | – |
| NL013 | 100 | 94 | 82 | 68 | 50 | 40 | 30 | 28 | 20 | 20 | + |
| NL015 | 100 | 100 | 72 | 30 | 18 | 12 | 8 | 6 | 6 | 6 | + |
| NL021 | 100 | 100 | 84 | 58 | 50 | 44 | 40 | 34 | 34 | 22 | + |

| | Chi squared | P value | Sig. Dif.[2] |
|---|---|---|---|
| diet versus: | | | |
| NL013 | 15.73 | <0.0001 | Yes |
| NL015 | 39.44 | <0.0001 | Yes |
| NL021 | 12.75 | 0.0004 | Yes |
| gfp dsRNA versus: | | | |
| NL013 | 16.42 | <0.0001 | Yes |
| NL015 | 39.15 | <0.0001 | Yes |
| NL021 | 14.1 | 0.0002 | Yes |
| diet versus gfp dsRNA | 0.1031 | 0.7481 | No |

[1]= Data were analysed using Kaplan-Meier survival curve analysis
[2]alpha < 0.05

TABLE 11-NL

| NL002 RNAi | Mean % survival (days post start) | | | | | | | | Survival analysis[1] |
|---|---|---|---|---|---|---|---|---|---|
| | 0 | 1 | 2 | 3 | 4 | 5 | 6 | 7 | |
| diet only | 100 | 100 | 96 | 90 | 86 | 78 | 78 | 78 | – |
| 1 µg/µl | 100 | 84 | 80 | 44 | 26 | 8 | 6 | 6 | + |
| 0.2 µg/µl | 100 | 84 | 60 | 12 | 8 | 4 | 2 | 2 | + |
| 0.08 µg/µl | 100 | 84 | 62 | 18 | 14 | 6 | 6 | 6 | + |
| 0.04 µg/µl | 100 | 84 | 48 | 24 | 22 | 22 | 22 | 22 | + |

| diet versus: | Chi squared | P value | Sig. Dif.[2] |
|---|---|---|---|
| NL002 1 µg/µl | 57.53 | <0.0001 | Yes |
| NL002 0.2 µg/µl | 74.54 | <0.0001 | Yes |
| NL002 0.08 µg/µl | 64 | <0.0001 | Yes |
| NL002 0.04 µg/µl | 39.49 | <0.0001 | Yes |

[1]= Data were analysed using Kaplan-Meier survival curve analysis
[2]alpha < 0.05

SEQUENCE LISTING (2486 sequences)

SEQ ID NO: 1 - DNA, 437 bp, Leptinotarsa decemlineata
ggccccaagaagcatttgaagcgtttgaatgccccaaaagcatggatgttggataaattgggaggtgttttcgcacctcgcccatctacaggacctcacaaattgcgagagtctttgcccttggtgatcttcctacgtaaccgattgaagtatgctttgactaacagcgaagttactaagattgttatgcaaaggttaatcaaagtagatggaaaagtgaggaccgactccaattaccctgctgggtttatggatgttattaccattgaaaaaactggtgaatttttccgactcatctatgatgttaaaggacgatttgcagtgcatcgtattactgctgaggaagcaaagtacaaactatgcaaagtcaggaggatgcaaactggccccaaaggaattcccttcatagtgacacacgacggccgcaccatccgcta

SEQ ID NO: 2 - protein, 145 aa, Leptinotarsa decemlineata
GPKKHLKRLNAPKAWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAVHRITAEEAKYKLCKVRRMQTGPKGIPFIVTHDGRTIR

SEQ ID NO: 3 - DNA, 220 bp, Leptinotarsa decemlineata
gcaatgtcatccatcatgtcgtgtacattgtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgcttcttccgcttcagcgcttgcatggccgctc

SEQ ID NO: 4 - protein, 71 aa, Leptinotarsa decemlineata
AMQALKRKKRLEKNQLQIDGTLTTIELQREALEGASTNTTVLESMKNAAEALKKAHKNLDVDNVHDMMDDI

SEQ ID NO: 5 - DNA, 490 bp, Leptinotarsa decemlineata
caggttcttcctcttgacgcgtccagggcgaccaccaccgaatggagatttgagcgagaagtcaatatgcttctgggaatcaagtctcacaatgaagcttggaatattcacgacctgcttacgaaccctgatatgtctttgacggaccagcacacgagcatgatggattgattttgcaagccccaacttgaaaacttgtgtttggagacgtcgttccaagaaatcttcaatcttcaaacccaagacgtaatcaagcttcatacgggtttcatccaacactccaatacgcaccaaccgacgaagaagagcattgccttcaaacaacctgcgctgatctttctcttccaaagtcagaagttctctggcagctttacggatttttgccaaggtatacttgactcgccacacttcacgtttgttcctaagaccatattctcctatgattttcaactcctgatcaagacgtgccttttcataaggtcgcctggga

SEQ ID NO: 6 - protein, 163 aa, Leptinotarsa decemlineata
PRRPYEKARLDQELKIIGEYGLRNKREVWRVKYTLAKIRKAARELLTLEEKDQRRLFEGNALLRRLVRIGVLDETRMKLDYVLGLKIEDFLERRLQTQVFKLGLAKSIHHARVLVRQRHIRVRKQVVNIPSFIVRLDSQKHIDFSLKSPFGGGRPGRVKRKNL

SEQ ID NO: 7 - DNA, 561 bp, Leptinotarsa decemlineata
ggagcgagactacacaactatggctggcaggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagcgaattggcgatcaagaagagcagttcgag

SEQ ID NO: 8 - protein, 183 aa, Leptinotarsa decemlineata
HNYGWQVLVASGVVEYIDTLEEETVMIAMNPEDLRQDKEYAYCTTYTHCEIHPAMILGVCASIIPFPDHNQSPRNTYQSAMGKQAMGVYITNFHVRMDTLAHVLYYPHKPLVTTRSMEYLRFRELPAGINSIVAIACYTGYNQEDSVILNASAVERGFFRSVFYRSYKDAESKRIGDQEEQFE

SEQ ID NO: 9 - DNA, 1031 bp, Leptinotarsa decemlineata
ccgaagaaggatgtgaagggtacttacgtatccatacacagttcaggcttcagagattttttattgaaaccagaaattctaagagctatagttgactgcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagggtcaacattgtcttcaactatgatatgccagaggactccgacacctacttgcatcg

SEQ ID NO: 10 - protein, 343 aa, Leptinotarsa decemlineata
PKKDVKGTYVSIHSSGFRDFLLKPEILRAIVDCGFEHPSEVQHECIPQAVIGMDILCQAKSGMGKTAVFVLATLQQLEPADNVVYVLVMCHTRELAFQISKEYERFSKYMPSVKVGVFFGGMPIANDEEVLKNKCPHIVVGTPGRILALVKSRKLVLKNLKHFILDECDKMLELLDMRRDVQEIYRNTPHTKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQKRILVATNLFGRGMDIERVNIVFNYDMPEDSDTYLH

SEQ ID NO: 11 - DNA, 1601 bp, Leptinotarsa decemlineata
ctctcaaggattcgttgcagatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgaaaccatcgcccaatggcg

SEQ ID NO: 12 - protein, 260 aa, Leptinotarsa decemlineata
VKCSRELKIQGGIGSCVSLNVKNPLVSDTEIGMGNTVQWKMCTVTPSTTMALFFEVVNQHSAPIPQGGRGCIQFITQYQHASGQKRIRVTTVARNWADASANIHHVSAGFDQEAAAVIMARMAVYRAESDDSPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 13 - DNA, 529 bp, Leptinotarsa decemlineata
gtggaagcagggctggcatggcgacaaattctagattgggatcaccaataagcttcctagctagccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttccagtacctccatctccgaccaacacacacttgaaagtggg

SEQ ID NO: 14 - protein, 176 aa, Leptinotarsa decemlineata
PTFKCVLVGDGGTGKTTFVKRHMTGEFEKRYVATLGVEVHPLVFHTNRGPIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALLP

SEQ ID NO: 15 - DNA, 607 bp, Leptinotarsa decemlineata
cgcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcaacttctgcccgagatccg

SEQ ID NO: 16 - protein, 201 aa, Leptinotarsa decemlineata
QIKHMMAFIEQEANEKAEEIDAKAEEEFNIEKGRLVQQQRLKIMEYYEKKEKQVELQKKIQSSNMLNQARLKVLKVREDHVRTVLEEARKRLGQVTNDQGKYSQILESLILQGLYQLFEKDVTIRVRPQDRELVKSIIPTVTNKYKDATGKDIHLKIDDEIHLSQETTGGIDLLAQKNKIKISNTMEARLELISQQLLPEI

SEQ ID NO: 17 - DNA, 257 bp, Leptinotarsa decemlineata
gcaatggcatcaagttcatcgatgaagatgatcgccggagagtttttgtcagcttcttcaaaagctttgcgcaagttactctcagactcgccagcgagtttgctcatgatctccggcccgtttatcaagaagaagaacgccccagtctcattagccacggcgcgagcaatcagggtcttacccgtaccagggggaccatacagcagtatacccctagggggcttcacgccgatagccttgaagagcgatggatggcg

SEQ ID NO: 18 - protein, 85 aa, Leptinotarsa decemlineata
RHPSLFKAIGVKPPRGILLYGPPGTGKTLIARAVANETGAFFFLINGPEIMSKLAGESESNLRKAFEEADKNSPAIIFIDELDAI

SEQ ID NO: 19 - DNA, 957 bp, Leptinotarsa decemlineata
ggaataggatgggtaatgtcgtcgttgggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattaccagaggaccgttcacaccagacacagtc

SEQ ID NO: 20 - protein, 318 aa, Leptinotarsa decemlineata
TVSGVNGPLVILEDVKFPKYNEIVQLKLADGTIRSGQVLEVSGSKAVVQVFEGTSGIDAKNTACEFTGDILRTPVSEDMLGRVFNGSGKPIDKGPPILAEDFLDIQGQPINPWSRIYPEEMIQTGITAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 21 - DNA, 789 bp, Leptinotarsa decemlineata
cacctggttcaaggatgggcagcggataacggagtcgcagaaatacgagagcaccttctcgaacaaccaagcctccttgagggtaaaacaagcccagtctgaggactcgggacactacactttgttggcggagaaccctcaaggctgcatagtgtcatctgcttacttagccatagaaccggtaaccacccaggaagggttgatccacgagtccaccttcaagcagcaacagaccgaaatggagcaaatcgacaccagcaagaccttggcgcctaacttcgtcagggtttgcggggatagagacgtgaccgagggcaagatgacccgcttcgactgtcgcgtcactggtcgtccttatccagacgtgacatggtacataaacggtcgacaagtcaccgacgaccacaaccacaagattttggttaacgaatccggaaaccatgccctgatgatcaccaccgtgagcaggaacgactcaggagtagtgacctgcgtcgccaggaacaagacgggagaaacctccttccagtgcaaccttaacgtcatcgaaaaggaacaggtagtcgcgcccaagttcgtggagagatttaccacagtcaacgtggcagaaggagaaccagtgtctctgcgcgctagagctgttggcacgccggtgccgcgaatcacttggcagagggacggggcgcccctagccagcgggcccgacgttcgcatcgcgattgacggtggagcctctactttgaatatctcgagggccaaggcctcggatgctgcatggtaccgatgcac

SEQ ID NO: 22 - protein, 262 aa, Leptinotarsa decemlineata
TWFKDGQRITESQKYESTFSNNQASLRVKQAQSEDSGHYTLLAENPQGCIVSSAYLAIEPVTTQEGLIHESTFKQQQTEMEQIDTSKTLAPNFVRVCGDRDVTEGKMTRFDCRVTGRPYPDVTWYINGRQVTDDHNHKILVNESGNHALMITTVSRNDSGVVTCVARNKTGETSFQCNLNVIEKEQVVAPKFVERFTTVNVAEGEPVSLRARAVGTPVPRITWQRDGAPLASGPDVRIAIDGGASTLNISRAKASDAAWYRC

SEQ ID NO: 23 - DNA, 1033 bp, Leptinotarsa decemlineata
ccatggtggcgataaaccatacttgatatcgggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccgaacaggtctttgggtcggagactgtttcatctatacc

SEQ ID NO: 24 - protein, 344 aa, Leptinotarsa decemlineata
HGGDKPYLISGADDRLVKIWDYQNKTCVQTLEGHAQNVTAVCFHPELPVALTGSEDGTVRVWHTNTHRLENCLNYGFERVWTICCLKGSNNVSLGYDEGSILVKVGREEPAVSMDASGGKIIWARHSELQQANLKALPEGGEIRDGERLPVSVKDMGACEIYPQTIQHNPNGRFVVVCGDGEYIIYTAMALRNKAFGSAQEFVWAQDSSEYAIRESGSTIRIFKNFKERKNFKSDFSAEGIYGGFLLGIKSVSGLTFYDWETLDLVRRIEIQPRAVYWSDSGKLVCLATEDSYFILSYDSEQVQKARENNQVAEDGVEAAFDVLGEMNESVRTGLWVGDCFIYT

SEQ ID NO: 25 - DNA, 23 bp, Artificial sequence
  Primer sequence
ggccccaagaagcatttgaagcg

SEQ ID NO: 26 - DNA, 23 bp, Artificial sequence
  Primer sequence
tagcggatggtgcgdccrtcrtg

SEQ ID NO: 27 - DNA, 29 bp, Artificial sequence
  Primer sequence
gagcggccatgcaagcvctbaarmrraag

SEQ ID NO: 28 - DNA, 26 bp, Artificial sequence
  Primer sequence
gcaatgtcatccatcakrtcrtgcac

SEQ ID NO: 29 - DNA, 26 bp, Artificial sequence
  Primer sequence
  misc_feature (18)..(18): n is a, c, g, or t
tcggtcttctcgaagacntaygtkac

SEQ ID NO: 30 - DNA, 24 bp, Artificial sequence
  Primer sequence
caggttcttcctcttkacrcgdcc

SEQ ID NO: 31 - DNA, 29 bp, Artificial sequence
  Primer sequence
ggagcgagactacaacaaykayrgytggc

SEQ ID NO: 32 - DNA, 24 bp, Artificial sequence
  Primer sequence
ctcgaactgctcytcytgatcrcc

SEQ ID NO: 33 - DNA, 23 bp, Artificial sequence
  Primer sequence
ccgaagaaggaygtsaagggyac

SEQ ID NO: 34 - DNA, 26 bp, Artificial sequence
  Primer sequence
cgatgcaagtaggtgtckgartcytc

SEQ ID NO: 35 - DNA, 25 bp, Artificial sequence
  Primer sequence
ctctcaaggattckytrcaratgtc

SEQ ID NO: 36 - DNA, 23 bp, Artificial sequence
  Primer sequence
cgccattgggcratggtytckcc

SEQ ID NO: 37 - DNA, 26 bp, Artificial sequence
  Primer sequence
cccactttcaagtgygtrytrgtcgg

SEQ ID NO: 38 - DNA, 25 bp, Artificial sequence
  Primer sequence
gtggaagcagggcwggcatkgcrac

SEQ ID NO: 39 - DNA, 22 bp, Artificial sequence
  Primer sequence
cgcagatcaarcayatgatggc

SEQ ID NO: 40 - DNA, 21 bp, Artificial sequence
  Primer sequence
cggatctcgggcasmarytgc

SEQ ID NO: 41 - DNA, 23 bp, Artificial sequence
  Primer sequence
cgccatccrtcgctsttcaaggc

SEQ ID NO: 42 - DNA, 24 bp, Artificial sequence
  Primer sequence
gcaatggcatcaakytcrtcratg

SEQ ID NO: 43 - DNA, 24 bp, Artificial sequence
  Primer sequence
gactgtgtctggtgtraacggwcc

SEQ ID NO: 44 - DNA, 24 bp, Artificial sequence
  Primer sequence
ggaataggatgggtratrtcgtcg

SEQ ID NO: 45 - DNA, 24 bp, Artificial sequence
  Primer sequence
cacctggttcaagratggvcarmg

SEQ ID NO: 46 - DNA, 23 bp, Artificial sequence
  Primer sequence
gtgcatcggtaccahschgcrtc

SEQ ID NO: 47 - DNA, 22 bp, Artificial sequence
  Primer sequence
ccatggtggcgayaarccvtac

SEQ ID NO: 48 - DNA, 27 bp, Artificial sequence
  Primer sequence
ggtatagatgaarcartcdccvaccca

SEQ ID NO: 49 - DNA, 26 bp, Leptinotarsa decemlineata
ggccccaagaagcatttgaagcgttt

SEQ ID NO: 50 - DNA, 41 bp, Leptinotarsa decemlineata
aatgccccaaaagcatggatgttggataaattgggaggtgt

SEQ ID NO: 51 - DNA, 23 bp, Leptinotarsa decemlineata
gaagttactaagattgttatgca

SEQ ID NO: 52 - DNA, 26 bp, Leptinotarsa decemlineata
attgaaaaaactggtgaatttttccg

SEQ ID NO: 53 - DNA, 25 bp, Leptinotarsa decemlineata
acacacgacggccgcaccatccgct

SEQ ID NO: 54 - DNA, 26 bp, Leptinotarsa decemlineata
acacacgacggccgcaccatccgcta

SEQ ID NO: 55 - DNA, 24 bp, Leptinotarsa decemlineata
cccaagaagcatttgaagcgtttg

SEQ ID NO: 56 - DNA, 23 bp, Leptinotarsa decemlineata
gcaatgtcatccatcatgtcgtg

SEQ ID NO: 57 - DNA, 27 bp, Leptinotarsa decemlineata
caggttcttcctcttgacgcgtccagg

SEQ ID NO: 58 - DNA, 25 bp, Leptinotarsa decemlineata
ttgagcgagaagtcaatatgcttct

SEQ ID NO: 59 - DNA, 30 bp, Leptinotarsa decemlineata
ttccaagaaatcttcaatcttcaaacccaa

SEQ ID NO: 60 - DNA, 21 bp, Leptinotarsa decemlineata
ttcatccaacactccaatacg

SEQ ID NO: 61 - DNA, 24 bp, Leptinotarsa decemlineata
aagagcattgccttcaaacaacct

SEQ ID NO: 62 - DNA, 26 bp, Leptinotarsa decemlineata
agttctctggcagctttacggatttt

SEQ ID NO: 63 - DNA, 21 bp, Leptinotarsa decemlineata
ccacacttcacgtttgttcct

SEQ ID NO: 64 - DNA, 21 bp, Leptinotarsa decemlineata
ccgtatgaagcttgattacgt

SEQ ID NO: 65 - DNA, 23 bp, Leptinotarsa decemlineata
aggaacaaacgtgaagtgtggcg

SEQ ID NO: 66 - DNA, 26 bp, Leptinotarsa decemlineata
agcgctatgggtaagcaagctatggg

SEQ ID NO: 67 - DNA, 27 bp, Leptinotarsa decemlineata
tgttatactggttataatcaagaagat

SEQ ID NO: 68 - DNA, 23 bp, Leptinotarsa decemlineata
gaagttcagcacgaatgtattcc

SEQ ID NO: 69 - DNA, 27 bp, Leptinotarsa decemlineata
caagcaagtgatgatgttcagtgccac

SEQ ID NO: 70 - DNA, 23 bp, Leptinotarsa decemlineata
tgcaagaaattcatgcaagatcc

SEQ ID NO: 71 - DNA, 21 bp, Leptinotarsa decemlineata
aaatgaaaagaataaaaaatt

SEQ ID NO: 72 - DNA, 23 bp, Leptinotarsa decemlineata
cagaatttcccagccataggaat

SEQ ID NO: 73 - DNA, 23 bp, Leptinotarsa decemlineata
agcagttcaaagatttccagaag

SEQ ID NO: 74 - DNA, 24 bp, Leptinotarsa decemlineata
ttccaaatcagcaaagagtacgag

SEQ ID NO: 75 - DNA, 21 bp, Leptinotarsa decemlineata
tacccgcagttcatgtaccat

SEQ ID NO: 76 - DNA, 23 bp, Leptinotarsa decemlineata
cagtcgctgatcatgatccagcc

SEQ ID NO: 77 - DNA, 23 bp, Leptinotarsa decemlineata
ctcatggacacgttcttccagat

SEQ ID NO: 78 - DNA, 22 bp, Leptinotarsa decemlineata
ggggctgcatacagttcatcac

SEQ ID NO: 79 - DNA, 22 bp, Leptinotarsa decemlineata
cccgcagttcatgtaccatttg

SEQ ID NO: 80 - DNA, 23 bp, Leptinotarsa decemlineata
gacaatgccaaatacatgaagaa

SEQ ID NO: 81 - DNA, 24 bp, Leptinotarsa decemlineata
ttcgatcaggaggcagccgcagtg

SEQ ID NO: 82 - DNA, 23 bp, Leptinotarsa decemlineata
agcagggctggcatggcgacaaa

SEQ ID NO: 83 - DNA, 26 bp, Leptinotarsa decemlineata
ttctcaaagttgtagttagatttggc

SEQ ID NO: 84 - DNA, 23 bp, Leptinotarsa decemlineata
tactgcaaattcttcttcctatg

SEQ ID NO: 85 - DNA, 22 bp, Leptinotarsa decemlineata
ggtacattcttgtatgtaactc

SEQ ID NO: 86 - DNA, 23 bp, Leptinotarsa decemlineata
tcaaacatgataatagcacactg

SEQ ID NO: 87 - DNA, 24 bp, Leptinotarsa decemlineata
tctcctgaccggcagtgtcccata

SEQ ID NO: 88 - DNA, 26 bp, Leptinotarsa decemlineata
gctactttgggagttgaagtccatcc

SEQ ID NO: 89 - DNA, 27 bp, Leptinotarsa decemlineata
taactacaactttgagaagcctttcct

SEQ ID NO: 90 - DNA, 23 bp, Leptinotarsa decemlineata
aagtttggtggtctccgtgatgg

SEQ ID NO: 91 - DNA, 21 bp, Leptinotarsa decemlineata
gcagatcaagcatatgatggc

SEQ ID NO: 92 - DNA, 26 bp, Leptinotarsa decemlineata
atcaagcatatgatggctttcattga

SEQ ID NO: 93 - DNA, 23 bp, Leptinotarsa decemlineata
aatattgaaaaggggcgccttgt

SEQ ID NO: 94 - DNA, 23 bp, Leptinotarsa decemlineata
caacgtctcaagattatggaata

SEQ ID NO: 95 - DNA, 26 bp, Leptinotarsa decemlineata
attatggaatattatgagaagaaaga

SEQ ID NO: 96 - DNA, 24 bp, Leptinotarsa decemlineata
aacaaaatcaagatcagcaatact

SEQ ID NO: 97 - DNA, 22 bp, Leptinotarsa decemlineata
atgtcgtcgttgggcatagtca

SEQ ID NO: 98 - DNA, 41 bp, Leptinotarsa decemlineata
gtagctaaatcggtgtacatgtaacctgggaaaccacgacg

SEQ ID NO: 99 - DNA, 23 bp, Leptinotarsa decemlineata
gcagatacctcacgcaaagcttc

SEQ ID NO: 100 - DNA, 29 bp, Leptinotarsa decemlineata
ggatcgttggccaaattcaagaacaggca

SEQ ID NO: 101 - DNA, 32 bp, Leptinotarsa decemlineata
ttctccatagaaccgttctcttcgaaatcctg

SEQ ID NO: 102 - DNA, 23 bp, Leptinotarsa decemlineata
gctgtttccatgttaacacccat

SEQ ID NO: 103 - DNA, 25 bp, Leptinotarsa decemlineata
tccatgttaacacccatagcagcga

SEQ ID NO: 104 - DNA, 29 bp, Leptinotarsa decemlineata
ctacagatctgggcagcaatttcattgtg

SEQ ID NO: 105 - DNA, 23 bp, Leptinotarsa decemlineata
ggcagaccagctgcagagaaaat

SEQ ID NO: 106 - DNA, 47 bp, Leptinotarsa decemlineata
gagaaaatggggatcttctgaccacgagcaatggagttcatcacgtc

SEQ ID NO: 107 - DNA, 23 bp, Leptinotarsa decemlineata
atggagttcatcacgtcaatagc

SEQ ID NO: 108 - DNA, 98 bp, Leptinotarsa decemlineata
gtctggatcatttcctcaggatagatacgggaccacggattgattggttgaccctggatgtccaagaagtcttcagccaaaattgggggacctttgtc

SEQ ID NO: 109 - DNA, 23 bp, Leptinotarsa decemlineata
attgggggacctttgtcgatggg

SEQ ID NO: 110 - DNA, 140 bp, Leptinotarsa decemlineata
atgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttt

SEQ ID NO: 111 - DNA, 26 bp, Leptinotarsa decemlineata
acagcttttgacccactgacttccag

SEQ ID NO: 112 - DNA, 57 bp, Leptinotarsa decemlineata
gacccactgacttccagaacttgtcccgaacgtatagtgccatcagccagtttgagt

SEQ ID NO: 113 - DNA, 23 bp, Leptinotarsa decemlineata
ggaccgttcacaccagacacagt

SEQ ID NO: 114 - DNA, 27 bp, Leptinotarsa decemlineata
gactgtgtctggtgtgaacggtcctct

SEQ ID NO: 115 - DNA, 23 bp, Leptinotarsa decemlineata
ttctcttcgaaatcctgtttgaa

SEQ ID NO: 116 - DNA, 24 bp, Leptinotarsa decemlineata
gactgtgtvtggtgtgaacggtcc

SEQ ID NO: 117 - DNA, 38 bp, Leptinotarsa decemlineata
ggtcgtcgtggtttcccaggttacatgtacaccgattt

SEQ ID NO: 118 - DNA, 22 bp, Leptinotarsa decemlineata
tgacagctgccgaattcttggc

SEQ ID NO: 119 - DNA, 26 bp, Leptinotarsa decemlineata
caagtcaccgacgaccacaaccacaa

SEQ ID NO: 120 - DNA, 21 bp, Leptinotarsa decemlineata
atcgcgattgacggtggagcc

SEQ ID NO: 121 - DNA, 22 bp, Leptinotarsa decemlineata
agacgatcggttggttaaaatc

SEQ ID NO: 122 - DNA, 23 bp, Leptinotarsa decemlineata
gatatgggagcatgtgaaatata

SEQ ID NO: 123 - DNA, 21 bp, Leptinotarsa decemlineata
ttagagaattgtttgaattat

SEQ ID NO: 124 - DNA, 21 bp, Leptinotarsa decemlineata
aagaagcatttgaagcgtttg

SEQ ID NO: 125 - DNA, 21 bp, Leptinotarsa decemlineata
gttcttcctcttgacgcgtcc

SEQ ID NO: 126 - DNA, 23 bp, Leptinotarsa decemlineata
gcagctttacggatttttgccaa

SEQ ID NO: 127 - DNA, 22 bp, Leptinotarsa decemlineata
tttcaactcctgatcaagacgt

SEQ ID NO: 128 - DNA, 23 bp, Leptinotarsa decemlineata
gctatgggtaagcaagctatggg

SEQ ID NO: 129 - DNA, 21 bp, Leptinotarsa decemlineata
aaagaataaaaaattatttga

SEQ ID NO: 130 - DNA, 23 bp, Leptinotarsa decemlineata
aagcaagtgatgatgttcagtgc

SEQ ID NO: 131 - DNA, 23 bp, Leptinotarsa decemlineata
atgatggctttcattgaacaaga

SEQ ID NO: 132 - DNA, 23 bp, Leptinotarsa decemlineata
aacgccccagtctcattagccac

SEQ ID NO: 133 - DNA, 21 bp, Leptinotarsa decemlineata
ttttggcgtcgattcctgatg

SEQ ID NO: 134 - DNA, 23 bp, Leptinotarsa decemlineata
gtgtacatgtaacctgggaaacc

SEQ ID NO: 135 - DNA, 29 bp, Leptinotarsa decemlineata
gtgtacatgtaacctgggaaaccacgacg

SEQ ID NO: 136 - DNA, 23 bp, Leptinotarsa decemlineata
tagcggatggtgcggccgtcgtg

SEQ ID NO: 137 - DNA, 25 bp, Leptinotarsa decemlineata
ttccaagaaatcttcaatcttcaaa

SEQ ID NO: 138 - DNA, 32 bp, Leptinotarsa decemlineata
gactgcggttttgaacacccttcagaagttca

SEQ ID NO: 139 - DNA, 23 bp, Leptinotarsa decemlineata
tgtcaagccaaatctggtatggg

SEQ ID NO: 140 - DNA, 21 bp, Leptinotarsa decemlineata
ggcttctcaaagttgtagtta

SEQ ID NO: 141 - DNA, 23 bp, Leptinotarsa decemlineata
ccatcacggagaccaccaaactt

SEQ ID NO: 142 - DNA, 24 bp, Leptinotarsa decemlineata
aaaggcttctcaaagttgtagtta

SEQ ID NO: 143 - DNA, 23 bp, Leptinotarsa decemlineata
tgtgctattatcatgtttgatgt

SEQ ID NO: 144 - DNA, 23 bp, Leptinotarsa decemlineata
actgccggtcaggagaagtttgg

SEQ ID NO: 145 - DNA, 25 bp, Leptinotarsa decemlineata
aatacaactttgagaagcctttcct

SEQ ID NO: 146 - DNA, 23 bp, Leptinotarsa decemlineata
caggagaagtttggtggtctccg

SEQ ID NO: 147 - DNA, 21 bp, Leptinotarsa decemlineata
accaccaaacttctcctgacc

SEQ ID NO: 148 - DNA, 25 bp, Leptinotarsa decemlineata
ggtcaggagaagttggtggtctccg

SEQ ID NO: 149 - DNA, 28 bp, Leptinotarsa decemlineata
gcagcaatttcattgtgaggcagaccag

SEQ ID NO: 150 - DNA, 23 bp, Leptinotarsa decemlineata
atggagttcatcacgtcaatagc

SEQ ID NO: 151 - DNA, 32 bp, Leptinotarsa decemlineata
ggtctgcctcacaatgaaattgctgcccagat

SEQ ID NO: 152 - DNA, 34 bp, Leptinotarsa decemlineata
ctattgttttcgctgctatgggtgttaacatgga

SEQ ID NO: 153 - DNA, 29 bp, Leptinotarsa decemlineata
atgaactccattgctcgtggtcagaagat

SEQ ID NO: 154 - DNA, 26 bp, Leptinotarsa decemlineata
ataggaatctgggtgatggatccgtt

SEQ ID NO: 155 - DNA, 24 bp, Leptinotarsa decemlineata
tcctgtttctgaagatatgttggg

SEQ ID NO: 156 - DNA, 27 bp, Leptinotarsa decemlineata
tttgaagattgaagatttcttggaacg

SEQ ID NO: 157 - DNA, 23 bp, Leptinotarsa decemlineata
tcacaggcagcgaagatggtacc

SEQ ID NO: 158 - DNA, 21 bp, Leptinotarsa decemlineata
ttctttgaagtttttgaatat

SEQ ID NO: 159 - DNA, 112 bp, Leptinotarsa decemlineata
tctagaatgttgaatcaggctcgattgaaagtattgaaggttagggaagatcacgttcgtaccgtactagaggaggcgcgtaaacgacttggtcaggtcacaaacgcccggg

SEQ ID NO: 160 - DNA, 72 bp, Leptinotarsa decemlineata
tctagaaagatcacgttcgtaccgtactagaggaggcgcgtaaacgacttggtcaggtcacaaacgcccggg

SEQ ID NO: 161 - DNA, 312 bp, Leptinotarsa decemlineata
tctagaatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgcccggg

SEQ ID NO: 162 - DNA, 312 bp, Leptinotarsa decemlineata
tctagaaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgcccggg

SEQ ID NO: 163 - DNA, 395 bp, Leptinotarsa decemlineata
ggccccaagaagcatttgaagcgtttgaatgccccaaaagcatggatgttggataaattgggaggtgttttcgcacctcgcccatctacaggacctcacaaattgcgagagtctttgcccttggtgatcttcctacgtaaccgattgaagtatgctttgactaacagcgaagttactaagattgttatgcaaaggttaatcaaagtagatggaaaagtgaggaccgactccaattaccctgctgggtttatggatgttattaccattgaaaaaactggtgaatttttccgactcatctatgatgttaaaggacgatttgcagtgcatcgtattactgctgaggaagcaaagtacaaactatgcaaagtcaggaggatgcaaactggccccaaagg

SEQ ID NO: 164 - DNA, 45 bp, Artificial sequence
  Primer sequence
gcgtaatacgactcactataggggccccaagaagcatttgaagcg

SEQ ID NO: 165 - DNA, 21 bp, Artificial sequence
  Primer sequence
cctttggggccagtttgcatc

SEQ ID NO: 166 - DNA, 23 bp, Artificial sequence
  Primer sequence
ggccccaagaagcatttgaagcg

SEQ ID NO: 167 - DNA, 43 bp, Artificial sequence
  Primer sequence
gcgtaatacgactcactataggcctttggggccagtttgcatc

SEQ ID NO: 168 - DNA, 162 bp, Leptinotarsa decemlineata
gtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgctt

SEQ ID NO: 169 - DNA, 46 bp, Artificial sequence
  Primer sequence
gcgtaatacgactcactatagggtccacgtccaagtttttatgggc

SEQ ID NO: 170 - DNA, 25 bp, Artificial sequence
  Primer sequence
aagcgattagaaaaaaatcagttgc

SEQ ID NO: 171 - DNA, 24 bp, Artificial sequence
  Primer sequence
gtccacgtccaagtttttatgggc

SEQ ID NO: 172 - DNA, 47 bp, Artificial sequence
  Primer sequence
gcgtaatacgactcactataggaagcgattagaaaaaaatcagttgc

SEQ ID NO: 173 - DNA, 318 bp, Leptinotarsa decemlineata
ggtgaccaccaccgaatggagatttgagcgagaagtcaatatgcttctgggaatcaagtctcacaatgaagcttggaatattcacgacctgcttacgaaccctgatatgtctttgacggaccagcacacgagcatgatggattgattttgcaagccccaacttgaaaacttgtgtttggagacgtcgttccaagaaatcttcaatcttcaaacccaagacgtaatcaagcttcatacgggtttcatccaacactccaatacgcaccaaccgacgaagaagagcattgccttcaaacaacctgcgctgatctttctctt

SEQ ID NO: 174 - DNA, 45 bp, Artificial sequence
  Primer sequence
gcgtaatacgactcactataggcccaggcgaccttatgaaaaggc

SEQ ID NO: 175 - DNA, 21 bp, Artificial sequence
  Primer sequence
ggtgaccaccaccgaatggag

SEQ ID NO: 176 - DNA, 23 bp, Artificial sequence
  Primer sequence
cccaggcgaccttatgaaaaggc

SEQ ID NO: 177 - DNA, 43 bp, Artificial sequence
  Primer sequence
gcgtaatacgactcactataggggtgaccaccaccgaatggag

SEQ ID NO: 178 - DNA, 503 bp, Leptinotarsa decemlineata
ggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagc

SEQ ID NO: 179 - DNA, 44 bp, Artificial sequence
  Primer sequence
gcgtaatacgactcactataggggtgttggttgcttctggtgtg

SEQ ID NO: 180 - DNA, 24 bp, Artificial sequence
  Primer sequence
gcttcgattcggcatctttatagg

SEQ ID NO: 181 - DNA, 22 bp, Artificial sequence
  Primer sequence
ggtgttggttgcttctggtgtg

SEQ ID NO: 182 - DNA, 46 bp, Artificial sequence
  Primer sequence
gcgtaatacgactcactatagggcttcgattcggcatctttatagg

SEQ ID NO: 183 - DNA, 883 bp, Leptinotarsa decemlineata
gactggcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagg

SEQ ID NO: 184 - DNA, 43 bp, Artificial sequence
  Primer sequence
gcgtaatacgactcactatagggactggcggttttgaacaccc

SEQ ID NO: 185 - DNA, 21 bp, Artificial sequence
  Primer sequence
cctttcaatgtccatgccacg

SEQ ID NO: 186 - DNA, 21 bp, Artificial sequence
  Primer sequence
gactggcggttttgaacaccc

SEQ ID NO: 187 - DNA, 43 bp, Artificial sequence
  Primer sequence
gcgtaatacgactcactataggcctttcaatgtccatgccacg

SEQ ID NO: 188 - DNA, 157 bp, Leptinotarsa decemlineata
gcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcag

SEQ ID NO: 189 - DNA, 41 bp, Artificial sequence
  Primer sequence
gcgtaatacgactcactatagggcttgttgcccccgaatgc

SEQ ID NO: 190 - DNA, 22 bp, Artificial sequence
  Primer sequence
ctatcgggttggatggaactcg

SEQ ID NO: 191 - DNA, 19 bp, Artificial sequence
  Primer sequence
gcttgttgcccccgaatgc

SEQ ID NO: 192 - DNA, 44 bp, Artificial sequence
  Primer sequence
gcgtaatacgactcactataggctatcgggttggatggaactcg

SEQ ID NO: 193 - DNA, 427 bp, Leptinotarsa decemlineata
gccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttcc

SEQ ID NO: 194 - DNA, 45 bp, Artificial sequence
  Primer sequence
gcgtaatacgactcactatagggccataggaaaggcttctcaaag

SEQ ID NO: 195 - DNA, 25 bp, Artificial sequence
  Primer sequence
ggaaaaacgacatttgtgaaacgtc

SEQ ID NO: 196 - DNA, 23 bp, Artificial sequence
  Primer sequence
gccataggaaaggcttctcaaag

SEQ ID NO: 197 - DNA, 47 bp, Artificial sequence
  Primer sequence
gcgtaatacgactcactataggggaaaaacgacatttgtgaaacgtc

SEQ ID NO: 198 - DNA, 563 bp, Leptinotarsa decemlineata
tttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgc

SEQ ID NO: 199 - DNA, 45 bp, Artificial sequence
  Primer sequence
gcgtaatacgactcactataggtttcattgaacaagaggcaaacg

SEQ ID NO: 200 - DNA, 22 bp, Artificial sequence
  Primer sequence
gcgaaatcagctccagacgagc

SEQ ID NO: 201 - DNA, 23 bp, Artificial sequence
  Primer sequence
tttcattgaacaagaggcaaacg

SEQ ID NO: 202 - DNA, 44 bp, Artificial sequence
  Primer sequence
gcgtaatacgactcactatagggcgaaatcagctccagacgagc

SEQ ID NO: 203 - DNA, 100 bp, Leptinotarsa decemlineata
atgttgaatcaggctcgattgaaagtattgaaggttagggaagatcacgttcgtaccgtactagaggaggcgcgtaaacgacttggtcaggtcacaaacg

SEQ ID NO: 204 - DNA, 43 bp, Artificial sequence
  Primer sequence
gcgtaatacgactcactataggatgttgaatcaggctcgattg

SEQ ID NO: 205 - DNA, 21 bp, Artificial sequence
  Primer sequence
cgtttgtgacctgaccaagtc

SEQ ID NO: 206 - DNA, 21 bp, Artificial sequence
  Primer sequence
atgttgaatcaggctcgattg

SEQ ID NO: 207 - DNA, 43 bp, Artificial sequence
  Primer sequence
gcgtaatacgactcactataggcgtttgtgacctgaccaagtc

SEQ ID NO: 208 - DNA, 59 bp, Leptinotarsa decemlineata
aagatcacgttcgtaccgtactagaggaggcgcgtaaacgacttggtcaggtcacaaac

SEQ ID NO: 209 - DNA, 43 bp, Artificial sequence
  Primer sequence
gcgtaatacgactcactataggaagatcacgttcgtaccgtac

SEQ ID NO: 210 - DNA, 19 bp, Artificial sequence
  Primer sequence
cgtttgtgacctgaccaag

SEQ ID NO: 211 - DNA, 21 bp, Artificial sequence
  Primer sequence
aagatcacgttcgtaccgtac

SEQ ID NO: 212 - DNA, 41 bp, Artificial sequence
  Primer sequence
gcgtaatacgactcactataggcgtttgtgacctgaccaag

SEQ ID NO: 213 - DNA, 302 bp, Leptinotarsa decemlineata
aatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgatgttgaatcaggctcgattgaaagtattgaaggttagggaagatcacgttcgtaccgtactagaggaggcgcgtaaacgacttggtcaggtcacaaacgc

SEQ ID NO: 214 - DNA, 302 bp, Leptinotarsa decemlineata
aaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgaagatcacgttcgtaccgtactagaggaggcgcgtaaacgacttggtcaggtcacaaacgc

SEQ ID NO: 215 - DNA, 203 bp, Leptinotarsa decemlineata
cgccggagagtttttgtcagcttcttcaaaagctttgcgcaagttactctcagactcgccagcgagtttgctcatgatctccggcccgtttatcaagaagaagaacgccccagtctcattagccacggcgcgagcaatcagggtcttacccgtaccagggggaccatacagcagtatacccctagggggcttcacgccgatag

SEQ ID NO: 216 - DNA, 43 bp, Artificial sequence
  Primer sequence
gcgtaatacgactcactataggcgccggagagtttttgtcagc

SEQ ID NO: 217 - DNA, 19 bp, Artificial sequence
  Primer sequence
ctatcggcgtgaagccccc

SEQ ID NO: 218 - DNA, 21 bp, Artificial sequence
  Primer sequence
cgccggagagtttttgtcagc

SEQ ID NO: 219 - DNA, 41 bp, Artificial sequence
  Primer sequence
gcgtaatacgactcactataggctatcggcgtgaagccccc

SEQ ID NO: 220 - DNA, 903 bp, Leptinotarsa decemlineata
ggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattacc

SEQ ID NO: 221 - DNA, 49 bp, Artificial sequence
  Primer sequence
gcgtaatacgactcactataggggcatagtcaatataggaatctgggtg

SEQ ID NO: 222 - DNA, 26 bp, Artificial sequence
  Primer sequence
ggtaatcctcgaagatgttaagttcc

SEQ ID NO: 223 - DNA, 27 bp, Artificial sequence
  Primer sequence
ggcatagtcaatataggaatctgggtg

SEQ ID NO: 224 - DNA, 48 bp, Artificial sequence
  Primer sequence
gcgtaatacgactcactataggggtaatcctcgaagatgttaagttcc

SEQ ID NO: 225 - DNA, 708 bp, Leptinotarsa decemlineata
ggagtcgcagaaatacgagagcaccttctcgaacaaccaagcctccttgagggtaaaacaagcccagtctgaggactcgggacactacactttgttggcggagaaccctcaaggctgcatagtgtcatctgcttacttagccatagaaccggtaaccacccaggaagggttgatccacgagtccaccttcaagcagcaacagaccgaaatggagcaaatcgacaccagcaagaccttggcgcctaacttcgtcagggtttgcggggatagagacgtgaccgagggcaagatgacccgcttcgactgtcgcgtcactggtcgtccttatccagacgtgacatggtacataaacggtcgacaagtcaccgacgaccacaaccacaagattttggttaacgaatccggaaaccatgccctgatgatcaccaccgtgagcaggaacgactcaggagtagtgacctgcgtcgccaggaacaagacgggagaaacctccttccagtgcaaccttaacgtcatcgaaaaggaacaggtagtcgcgcccaagttcgtggagagatttaccacagtcaacgtggcagaaggagaaccagtgtctctgcgcgctagagctgttggcacgccggtgccgcgaatcacttggcagagggacggggcgcccctagccagcgggcccgacgttcgcatcgcgattgacggtggagcctctac

SEQ ID NO: 226 - DNA, 46 bp, Artificial sequence
  Primer sequence
gcgtaatacgactcactataggggagtcgcagaaatacgagagcac

SEQ ID NO: 227 - DNA, 23 bp, Artificial sequence
  Primer sequence
gtagaggctccaccgtcaatcgc

SEQ ID NO: 228 - DNA, 24 bp, Artificial sequence
  Primer sequence
ggagtcgcagaaatacgagagcac

SEQ ID NO: 229 - DNA, 45 bp, Artificial sequence
  Primer sequence
gcgtaatacgactcactatagggtagaggctccaccgtcaatcgc

SEQ ID NO: 230 - DNA, 967 bp, Leptinotarsa decemlineata
gggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccga

SEQ ID NO: 231 - DNA, 42 bp, Artificial sequence
  Primer sequence
gcgtaatacgactcactatagggggagcagacgatcggttgg

SEQ ID NO: 232 - DNA, 23 bp, Artificial sequence
  Primer sequence
tcggacagactcgttcatttccc

SEQ ID NO: 233 - DNA, 20 bp, Artificial sequence
  Primer sequence
gggagcagacgatcggttgg

SEQ ID NO: 234 - DNA, 45 bp, Artificial sequence
  Primer sequence
gcgtaatacgactcactataggtcggacagactcgttcatttccc

SEQ ID NO: 235 - DNA, 258 bp, Leptinotarsa decemlineata
agatacccagatcatatgaaacggcatgactttttcaagagtgccatgcccgaaggttatgtacaggaaagaactatatttttcaaagatgacgggaactacaagacacgtaagtttaaacagttcggtactaactaaccatacatatttaaattttcaggtgctgaagtcaagtttgaaggtgatacccttgttaatagaatcgagttaaaaggtattgattttaaagaagatggaaacattcttggacacaaattg

SEQ ID NO: 236 - DNA, 46 bp, Artificial sequence
  Primer sequence
gcgtaatacgactcactataggagatacccagatcatatgaaacgg

SEQ ID NO: 237 - DNA, 24 bp, Artificial sequence
  Primer sequence
caatttgtgtccaagaatgtttcc

SEQ ID NO: 238 - DNA, 24 bp, Artificial sequence
  Primer sequence
agatacccagatcatatgaaacgg

SEQ ID NO: 239 - DNA, 46 bp, Artificial sequence
  Primer sequence
gcgtaatacgactcactataggcaatttgtgtccaagaatgtttcc

SEQ ID NO: 240 - DNA, 1961 bp, Leptinotarsa decemlineata
gcccttgcaatgtcatccatcatgtcgtgtacattgtccacgtccaagtttttatgggctttcttaagagcttcagctgcatttttcatagattccaatactgtggtgttcgtactagctccctccagagcttctcgttgaagttcaatagtagttaaagtgccatctatttgcaactgatttttttctaatcgcttcttccgcttcagcgcttgcatggccgctcaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgagcggccatgcaagcgctgaagcggaagaagcgattagaaaaaaatcagttgcaaatagatggcactttaactactattgaacttcaacgagaagctctggagggagctagtacgaacaccacagtattggaatctatgaaaaatgcagctgaagctcttaagaaagcccataaaaacttggacgtggacaatgtacacgacatgatggatgacattgcaagggc

SEQ ID NO: 241 - DNA, 2640 bp, Leptinotarsa decemlineata
gcccttggagcgagactacaacaactatggctggcaggtgttggttgcttctggtgtggtggaatacatcgacactcttgaagaagaaactgtcatgattgcgatgaatcctgaggatcttcggcaggacaaagaatatgcttattgtacgacctacacccactgcgaaatccacccggccatgatcttgggcgtttgcgcgtctattatacctttccccgatcataaccagagcccaaggaacacctaccagagcgctatgggtaagcaagctatgggggtctacattacgaatttccacgtgcggatggacaccctggcccacgtgctatactacccgcacaaacctctggtcactaccaggtctatggagtatctgcggttcagagaattaccagccgggatcaacagtatagttgctattgcttgttatactggttataatcaagaagattctgttattctgaacgcgtctgctgtggaaagaggatttttccgatccgtgttttatcgttcctataaagatgccgaatcgaagcgaattggcgatcaagaagagcagttcgagaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcggcccttctcgaactgctcttcttgatcgccaattcgcttcgattcggcatctttataggaacgataaaacacggatcggaaaaatcctctttccacagcagacgcgttcagaataacagaatcttcttgattataaccagtataacaagcaatagcaactatactgttgatcccggctggtaattctctgaaccgcagatactccatagacctggtagtgaccagaggtttgtgcgggtagtatagcacgtgggccagggtgtccatccgcacgtggaaattcgtaatgtagacccccatagcttgcttacccatagcgctctggtaggtgttccttgggctctggttatgatcggggaaaggtataatagacgcgcaaacgcccaagatcatggccgggtggatttcgcagtgggtgtaggtcgtacaataagcatattctttgtcctgccgaagatcctcaggattcatcgcaatcatgacagtttcttcttcaagagtgtcgatgtattccaccacaccagaagcaaccaacacctgccagccatagttgttgtagtctcgctccaagggc

SEQ ID NO: 242 - DNA, 3584 bp, Leptinotarsa decemlineata
gcccttccgaagaaggatgtgaagggtacttacgtatccatacacagttcaggcttcagagattttttattgaaaccagaaattctaagagctatagttgactgcggttttgaacacccttcagaagttcagcacgaatgtattcctcaagctgtcattggcatggacattttatgtcaagccaaatctggtatgggcaaaacggcagtgtttgttctggcgacactgcaacaattggaaccagcggacaatgttgtttacgttttggtgatgtgtcacactcgtgaactggctttccaaatcagcaaagagtacgagaggttcagtaaatatatgcccagtgtcaaggtgggcgtctttttcggaggaatgcctattgctaacgatgaagaagtattgaaaaacaaatgtccacacattgttgtggggacgcctgggcgtattttggcgcttgtcaagtctaggaagctagtcctcaagaacctgaaacacttcattcttgatgagtgcgataaaatgttagaactgttggatatgaggagagacgtccaggaaatctacagaaacacccctcacaccaagcaagtgatgatgttcagtgccacactcagcaaagaaatcaggccggtgtgcaagaaattcatgcaagatccaatggaggtgtatgtagacgatgaagccaaattgacgttgcacggattacaacagcattacgttaaactcaaagaaaatgaaaagaataaaaaattatttgagttgctcgatgttctcgaatttaatcaggtggtcatttttgtgaagtccgttcaaaggtgtgtggctttggcacagttgctgactgaacagaatttcccagccataggaattcacagaggaatggaccagaaagagaggttgtctcggtatgagcagttcaaagatttccagaagagaatattggtagctacgaatctctttgggcgtggcatggacattgaaagggtcaacattgtcttcaactatgatatgccagaggactccgacacctacttgcatcgaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctgggtcgaattcgcccttcgatgcaagtaggtgtcggagtcctctggcatatcatagttgaagacaatgttgaccctttcaatgtccatgccacgcccaaagagattcgtagctaccaatattctcttctggaaatctttgaactgctcataccgagacaacctctctttctggtccattcctctgtgaattcctatggctgggaaattctgttcagtcagcaactgtgccaaagccacacacctttgaacggacttcacaaaaatgaccacctgattaaattcgagaacatcgagcaactcaaataattttttattcttttcattttctttgagtttaacgtaatgctgttgtaatccgtgcaacgtcaatttggcttcatcgtctacatacacctccattggatcttgcatgaatttcttgcacaccggcctgatttctttgctgagtgtggcactgaacatcatcacttgcttggtgtgaggggtgtttctgtagatttcctggacgtctctcctcatatccaacagttctaacattttatcgcactcatcaagaatgaagtgtttcaggttcttgaggactagcttcctagacttgacaagcgccaaaatacgcccaggcgtccccacaacaatgtgtggacatttgtttttcaatacttcttcatcgttagcaataggcattcctccgaaaaagacgcccaccttgacactgggcatatatttactgaacctctcgtactctttgctgatttggaaagccagttcacgagtgtgacacatcaccaaaacgtaaacaacattgtccgctggttccaattgttgcagtgtcgccagaacaaacactgccgttttgcccataccagatttggcttgacataaaatgtccatgccaatgacagcttgaggaatacattcgtgctgaacttctgaagggtgttcaaaaccgcagtcaactatagctcttagaatttctggtttcaataaaaaatctctgaagcctgaactgtgtatggatacgtaagtacccttcacatccttcttcggaagggc

SEQ ID NO: 243 - DNA, 4723 bp, Leptinotarsa decemlineata
gcccttcgccattgggcgatggtttcgccatggaatatcagaatctggaagaacgtgtccatgagcagaattctatcgggttggatggaactcgtatccaaaagcacaggttctggtggtccattgaaactgtagctgtagagtatcggctggatcatgatcagcgactgcgtgaggtcttcgcgcataagcatgtgcctgtagaaggacgtttcgtcgggagaattgttaaacacctgcaggaactgtgaccttctcaaatggtacatgaactgcgggtagaggctgaagttttcgcccaagcggaacgaattcgggtcgtccttgttatattcgccgaatttctggcacagacgtatcaacatcctatcgacccatctcaaaacatcagggctatcgtctgattccgctctgtaaactgccatcctcgccattatcactgcggctgcctcctgatcgaatccagcactgacatgatgtatattagcggaagcatcggcccagtttctagcaactgtcgttactcggatcctcttctggccactagcatgctgatattgcgtgatgaactgtatgcagccccttcccccttgaggtatgggagcggaatgttggttgacgacctcgaagaacaaggccatggtagtacttggagttaccgtacacattttccactggaccgtgttacccattcctatttcggtgtcggaaaccaaaggattcttcacattcaacgaaacacaagatccaataccgccttgaattttcaactccctggaacacttgaccctccagagtaccattaaatgccatcttcagctcgtttttctgatctttcgaaaatatgcgctggaacgtttgcttgaacagggaagaattgaacgagtcgcccatgaccatatgtccccctgttgaattacaacactgtttcatctccatcaatcctgtctgatccaaagcgcatgaatatatgtcaacgcagtggccattcgttgctgctctcatcgctaaattatcatagtgcttgattgctttcttcatgtatttggcattgtctttttggatgtcgtggtgagatctgataggttgcttcagatcatcattcaagacttgaccagggccttgagagcaaggtcctccaacgaatagcatgaccctggcaccagtattggcgtatgtgcactccaacaacccaatggctatcgataaagctgtcccggtcgatctaagggcgcatttgccttggtggacaggccatgggtctctttgcaactctccaataagatcagtgaggttcatgtcgcatttcgagatgggttgaaggaacctgcttcctggtggcgtaggagcttgctggagtgctccaggcctcatgggttgtcctggttgttgaggagcaggttgagcacttactgcggctctgcccacttccaacatctcttgaacttgcttagctgtgaggtctttcgtccctcggaaaacgtaagatttgctgcagccctcggtacctagttcgtgcacttggaccatcttcccaaaggtaatcaaccctatcaaggcattcgggggcaacaagctcaaagacatctgcaacgaatccttgagagaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctggtcgaattcgcccttctctcaaggattcgttgcagatgtctttgagcttgttgcccccgaatgccttgatagggttgattacctttgggaagatggtccaagtgcacgaactaggtaccgagggctgcagcaaatcttacgttttccgagggacgaaagacctcacagctaagcaagttcaagagatgttggaagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaatgcgcccttagatcgaccgggacagctttatcgatagccattgggttgttggagtgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagagcagcaacgaatggccactgcgttgacatatattcatgcgctttggatcagacaggattgatggagatgaaacagtgttgtaattcaacagggggacatatggtcatgggcgactcgttcaattcttccctgttcaagcaaacgttccagcgcatattttcgaaagatcagaaaaacgagctgaagatggcatttaatggtactctggagggtcaagtgttccagggagttgaaaattcaaggcggtattggatcttgtgtttcgttgaatgtgaagaatcctttggtttccgacaccgaaataggaatgggtaacacggtccagtggaaaatgtgtacggtaactccaagtactaccatggccttgttcttcgaggtcgtcaaccaacattccgctcccatacctcaagggggaaggggctgcatacagttcatcacgcaatatcagcatgctagtggccagaagaggatccgagtaacgacagttgctagaaactgggccgatgcttccgctaatatacatcatgtcagtgctggattcgatcaggaggcagccgcagtgataatggcgaggatggcagtttacagagcggaatcagacgatagccctgatgttttgagatgggtcgataggatgttgatacgtctgtgccagaaattcggcgaatataacaaggacgacccgaattcgttccgcttgggcgaaaacttcagcctctacccgcagttcatgtaccatttgagaaggtcacagttcctgcaggtgtttaacaattctcccgacgaaacgtccttctacaggcacatgcttatgcgcgaagacctcacgcagtcgctgatcatgatccagccgatactctacagctacagtttcaatggaccaccagaacctgtgcttttggatacgagttccatccaacccgatagaattctgctcatggacacgttcttccagattctgatattccatggcgaaaccatcgcccaatggcgaagggc

SEQ ID NO: 244 - DNA, 2584 bp, Leptinotarsa decemlineata
gcccttgtggaagcagggctggcatggcgacaaattctagattgggatcaccaataagcttcctagctagccataggaaaggcttctcaaagttgtagttagatttggcagagatatcatagtactgcaaattcttcttcctatgaaagacaatacttttcgcttttacttttctgtctttgatgtcaaccttgttcccgcaaagtactatcgggatattttcacagactctgacaagatctctgtgccaatttggtacattcttgtatgtaactctggaagttacatcaaacatgataatagcacactgtccctgaatgtaatatccatcacggagaccaccaaacttctcctgaccggcagtgtcccatacattgaaccgaatagggcccctgtttgtatggaagaccagaggatggacttcaactcccaaagtagctacatatcttttttcaaattcaccagtcatatgacgtttcacaaatgtcgtttttccagtacctccatctccgaccaacacacacttgaaagtgggaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcggaccactttgtacaagaaagctgggtcgaattcgcccttcccactttcaagtgtgtgttggtcggagatggaggtactggaaaaacgacatttgtgaaacgtcatatgactggtgaatttgaaaaaagatatgtagctactttgggagttgaagtccatcctctggtcttccatacaaacaggggccctattcggttcaatgtatgggacactgccggtcaggagaagtttggtggtctccgtgatggatattacattcagggacagtgtgctattatcatgtttgatgtaacttccagagttacatacaagaatgtaccaaattggcacagagatcttgtcagagtctgtgaaaatatcccgatagtactttgcgggaacaaggttgacatcaaagacagaaaagtaaaagcgaaaagtattgtctttcataggaagaagaatttgcagtactatgatatctctgccaaatctaactacaactttgagaagcctttcctatggctagctaggaagcttattggtgatcccaatctagaatttgtcgccatgccagccctgcttccacaagggc

SEQ ID NO: 245 - DNA, 2736 bp, Leptinotarsa decemlineata
gcccttcgcagatcaagcatatgatggctttcattgaacaagaggcaaacgaaaaggcagaagaaatcgatgccaaggccgaggaagaatttaatattgaaaaggggcgccttgttcagcaacaacgtctcaagattatggaatattatgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcaacttctgcccgagatccgaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcgaccactttgtacaagaaagctgggtcgaattcgcccttcggatctcgggcagaagttgctgcgaaatcagctccagacgagcctccatagtattgctgatcttgattttgtttttctgcgccagcaggtcgattcccccggtggtttcttgggacagatggatttcgtcatcaattttcagatggatgtccttaccggtggcatctttatacttgttcgtgacggtgggaatgatggatttgaccagttctcggtcctggggccgaactcgaatggtaacatctttctcaaaaagctgatataatccctgcaaaatgaggctttccaggatttgggaatattttccctggtcgtttgtgacctgaccaagtcgtttacgcgcctcctctagtacggtacgaacgtgatcttccctaaccttcaatactttcaatcgagcctgattcaacatgttagacgattggatttttttctggagttcgacctgtttctctttcttctcataatattccataatcttgagacgttgttgctgaacaaggcgccccttttcaatattaaattcttcctcggccttggcatcgatttcttctgccttttcgtttgcctcttgttcaatgaaagccatcatatgcttgatctgcgaagggc

SEQ ID NO: 246 - DNA, 3435 bp, Leptinotarsa decemlineata
gcccttggaataggatgggtaatgtcgtcgttgggcatagtcaatataggaatctgggtgatggatccgttacgtccttcaacacggccggcacgttcatagatggtagctaaatcggtgtacatgtaacctgggaaaccacgacgaccaggcacctcttctctggcagcagatacctcacgcaaagcttctgcatacgaagacatatctgtcaagatgaccaagacgtgcttctcacattggtaagccaagaattcggcagctgtcaaagccagacgaggtgtaataattctttcaatggtaggatcgttggccaaattcaagaacaggcagacattctccatagaaccgttctcttcgaaatcctgtttgaagaacctagctgtttccatgttaacacccatagcagcgaaaacaatagcaaagttatcttcatgatcatcaagtacagatttaccaggaatcttgactaaaccagcctgtctacagatctgggcagcaatttcattgtgaggcagaccagctgcagagaaaatggggatcttctgaccacgagcaatggagttcatcacgtcaatagctgtaatacccgtctggatcatttcctcaggatagatacgggaccacggattgattggttgaccctggatgtccaagaagtcttcagccaaaattgggggacctttgtcgatgggttttcctgatccattgaaaacacgtcccaacatatcttcagaaacaggagtcctcaaaatatctcctgtgaattcacaagcggtgtttttggcgtcgattcctgatgtgccctcgaacacttgaaccacagcttttgacccactgacttccagaacttgtcccgaacgtatagtgccatcagccagtttgagttgtacgatttcattgtacttggggaacttaacatcttcgaggattaccagaggaccgttcacaccagacacagtcaagggcgaattcaccagctttcttgtacaaagtggtatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgactgtgtctggtgtgaacggtcctctggtaatcctcgaagatgttaagttccccaagtacaatgaaatcgtacaactcaaactggctgatggcactatacgttcgggacaagttctggaagtcagtgggtcaaaagctgtggttcaagtgttcgagggcacatcaggaatcgacgccaaaaacaccgcttgtgaattcacaggagatattttgaggactcctgtttctgaagatatgttgggacgtgttttcaatggatcaggaaaacccatcgacaaaggtcccccaattttggctgaagacttcttggacatccagggtcaaccaatcaatccgtggtcccgtatctatcctgaggaaatgatccagacgggtattacagctattgacgtgatgaactccattgctcgtggtcagaagatccccattttctctgcagctggtctgcctcacaatgaaattgctgcccagatctgtagacaggctggtttagtcaagattcctggtaaatctgtacttgatgatcatgaagataactttgctattgttttcgctgctatgggtgttaacatggaaacagctaggttcttcaaacaggatttcgaagagaacggttctatggagaatgtctgcctgttcttgaatttggccaacgatcctaccattgaaagaattattacacctcgtctggctttgacagctgccgaattcttggcttaccaatgtgagaagcacgtcttggtcatcttgacagatatgtcttcgtatgcagaagctttgcgtgaggtatctgctgccagagaagaggtgcctggtcgtcgtggtttcccaggttacatgtacaccgatttagctaccatctatgaacgtgccggccgtgttgaaggacgtaacggatccatcacccagattcctatattgactatgcccaacgacgacattacccatcctattccaagggc

SEQ ID NO: 247 - DNA, 537 bp, Phaedon cochleariae
catttgaagcgtttagctgctcccaaagcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatctggcaacctctgcatgatcacggggagg

SEQ ID NO: 248 - protein, 161 aa, Phaedon cochleariae
AWMLDKLGGVFAPRPSTGPHKLRESLPLVIFLRNRLKYALTNSEVTKIVMQRLIKVDGKVRTDSNYPAGFMDVITIEKTGEFFRLIYDVKGRFAVHRITAEEAKYKLCKVRRVQTGPKGIPFLVTHDGRTIRYPDPNIKVNDTIQMEIATSKILDYIKFES

SEQ ID NO: 249 - DNA, 477 bp, Phaedon cochleariae
ccctagacgtccctatgaaaaggcccgtctggatcaggaattgaaaattatcggcgcctttggtttacgaaacaaacgtgaagtgtggagagtaaagtacactttggctaaaatccgtaaagctgctcgtgaactgctcaccctagaagaaaaagagcctaaaagattgtttgaaggtaatgcacttctacgtcgtttggtgcgaattggtgttctggatgagaacaggatgaagcttgattatgttttgggtctgaaaattgaagatttcttggaaagaaggctccaaactcaggtgttcaaatctggtctggcaaagtcaattcatcatgctagagtactgattaggcagagacacatccgggtgcgcaagcaggtggtgaacatcccctcgttcatcgtgcggctggactcgcagaagcacatcgacttctccctgaagtcgcccttcgggggtggccgacctggccgtgtcaa

SEQ ID NO: 250 - protein, 158 aa, Phaedon cochleariae
PRRPYEKARLDQELKIIGAFGLRNKREVWRVKYTLAKIRKAARELLTLEEKEPKRLFEGNALLRRLVRIGVLDENRMKLDYVLGLKIEDFLERRLQTQVFKSGLAKSIHHARVLIRQRHIRVRKQVVNIPSFIVRLDSQKHIDFSLKSPFGGGRPGRV

SEQ ID NO: 251 - DNA, 504 bp, Phaedon cochleariae
tgcgatgcggcaaaaagaaggtgtggttggatccaaatgaaatcaacgaaatcgccaacaccaactcaagacaaaacatccgtaagctcatcaaggatggtcttatcatcaagaagccagtggcagtacactctagggcccgtgtacgcaagaacactgaagccagaaggaagggaaggcattgtggatttggaaagaggaagggtacggcaaatgcccgtatgcctcaaaaggaactgtgggtgcagcgcatgcgcgtcctcaggcgcctcctcaaaaagtacagggaggccaagaaaatcgaccgccatctttaccacgccctgtacatgaaagcgaagggtaacgtgttcaggaacaagagggtccttatggagtacatccacaagaagaaggcagagaaggccagggccaagatgctgtctgaccaggctaacgccaggagattgaaggtgaagcaggccagggaacgtagggaagagcgtatcgccaccaagaagcagg

SEQ ID NO: 252 - protein, 149 aa, Phaedon cochleariae
PNEINEIANTNSRQNIRKLIKDGLIIKKPVAVHSRARVRKNTEARRKGRHCGFGKRKGTANARMPQKELWVQRMRVLRRLLKKYREAKKIDRHLYHALYMKAKGNVFRNKRVLMEYIHKKKAEKARAKMLSDQANARRLKVKQARERRE

SEQ ID NO: 253 - DNA, 1594 bp, Phaedon cochleariae
ctctcaaggattctttgcagatgtcgctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccatggagagaccattgcccaatggcg

SEQ ID NO: 254 - protein, 530 aa, Phaedon cochleariae
LKDSLQMSLSLLPPNALIGLITFGKMVQVHELGTEGCSKSYVFCGTKDLTAKQVQEMLGIGKGSPNPQQQPGQPGRPGQNPQAAPVPPGSRFLQPVSKCDMNLTDLIGELQKDPWPVHQGKRPLRSTGAALSIAVGLLECTYPNTGGRIMIFLGGPCSQGPGQVLNDDLKQPIRSHHDIHKDNAKYMKKAIKHYDHLAMRAATNSHCIDIYSCALDQTGLMEMKQCCNSTGGHMVMGDSFNSSLFKQTFQRVFSKDPKNDLKMAFNATLEVKCSRELKVQGGIGSCVSLNVKSPLVSDTELGMGNTVQWKLCTLAPSSTVALFFEVVNQHSAPIPQGGRGCIQLITQYQHASGQRRIRVTTIARNWADATANIHHISAGFDQEAAAVVMARMAGYKAESDETPDVLRWVDRMLIRLCQKFGEYNKDDPNSFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 255 - DNA, 598 bp, Phaedon cochleariae
ctgatgttcaaaaacaaatcaaacacatgatggctttcattgaacaagaagccaatgagaaagcagaagaaattgatgccaaggcagaggaggaattcaacattgaaaaagggcgtttggtccagcaacagagactcaagatcatggagtactacgagaaaaaggagaagcaagtcgaacttcaaaagaaaattcagtcctctaatatgttgaatcaggctcgtttgaaggtgctgaaagtgagagaggaccatgtcagagcagtcctggaggatgctcgtaaaagtcttggtgaagtaaccaaagaccaaggaaaatactcccaaattttggagagcctaatcctacaaggactgttccagctgttcgagaaggaggtgacggtccgcgtgagaccgcaagacagggacctggtcaggtccatcctgcccaacgtcgctgccaaatacaaggacgccaccggcaaagacatcctactcaaggtggacgatgagtcgcacctgtctcaggagatcaccggaggcgtcgatttgctcgctcagaagaacaagatcaagatcagcaacacgatggaggctaggttggatctgatcgctca

SEQ ID NO: 256 - protein, 198 aa, Phaedon cochleariae
DVQKQIKHMMAFIEQEANEKAEEIDAKAEEEFNIEKGRLVQQQRLKIMEYYEKKEKQVELQKKIQSSNMLNQARLKVLKVREDHVRAVLEDARKSLGEVTKDQGKYSQILESLILQGLFQLFEKEVTVRVRPQDRDLVRSILPNVAAKYKDATGKDILLKVDDESHLSQEITGGVDLLAQKNKIKISNTMEARLDLIA

SEQ ID NO: 257 - DNA, 957 bp, Phaedon cochleariae
ggaataggatgggtgatgtcgtcgttgggcatagtcaagatggggatctgcgtgatggagccgttgcggccctccacacgaccggcgcgctcgtaaatggtggccagatcggtgtacatgtaaccggggaaacccctacggccgggcacttcttctcgagcggcagacacctcacgcaacgcctccgcgtacgacgacatgtcggtcaagatgaccagcacgtgcttctcgcactggtaggccaagaattcggcggccgtcagagccaaacgcggcgtgatgatgcgctcgatggtcggatcgttggccaagttcaagaacagacacacgttctccatcgagccgttctcttcgaagtcctgcttgaagaacctggcagtttccatgttgacacccatagcagcaaacacaatagcaaagttgtcttcatggtcatccagcacagacttgccaggtactttgaccaagccagcctgcctacaaatctgggctgcaatctcattgtggggcagcccagcggcggagaagatcggaatcttctgccctctggcgatagagttcatcacgtcgatggccgtgatcccagtctggatcatttcctcgggataaatacgcgaccacgggttgatcggctgtccttggatgtcgaggtagtcctcagccaggatcgggggacctttatcaatgggttttcctgatccattgaagacacgtcccagcatatcttctgatactggagttcttagaatatctccagtgaactcacacaccgtgttcttagcatcaatacctgatgtgccttcaaatacctgaacaactgcctttgatccactgacttccaaaacttgtccagatcgtagagttccatctgccaatttgagctggacaatttcattgaattttggaaacttgacatcctcaagaatgaccagtggtccgttcacaccagacacagtc

SEQ ID NO: 258 - protein, 302 aa, Phaedon cochleariae
LVILEDVKFPKFNEIVQLKLADGTLRSGQVLEVSGSKAVVQVFEGTSGIDAKNTVCEFTGDILRTPVSEDMLGRVFNGSGKPIDKGPPILAEDYLDIQGQPINPWSRIYPEEMIQTGITAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMP

SEQ ID NO: 259 - DNA, 922 bp, Phaedon cochleariae
gggccaagcacagtgaaatacagcaagctaacttgaaagcactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtgtctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgccgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcaattgctattatctgtactcgaatatcagactgcagtcatgcgacgagacttcccaacggctgatcgagtattgccttcaattccaaaagaacatcgcactagggtggcaca

SEQ ID NO: 260 - protein, 291 aa, Phaedon cochleariae
  misc_feature (263)..(263): Xaa can be any naturally occurring amino acid
QANLKVLPEGAEIRDGERLPVTVKDMGACEIYPQTIQHNPNGRFVVVCGDGEYIIYTAMALRNKAFGSAQEFVWAQDSSEYAIRESGSTIRIFKNFKEKKNFKSDFGAEGIYGGFLLGVKSVSGLAFYDWETLELVRRIEIQPRAIYWSDSGKLVCLATEDSYFILSYDSDQVQKARDNNQVAEDGVEAAFDVLGEINESVRTGLWVGDCFIYTNAVNRINYFVGGELVTIAHLDRPLYVLGYVPRDDRLYLVDKELGVVSYXIAIICTRISDCSHATRLPNGSSIAFNSK

SEQ ID NO: 261 - DNA, 23 bp, Artificial sequence
  Primer sequence
catttgaagcgtttwrmygcycc

SEQ ID NO: 262 - DNA, 28 bp, Artificial sequence
  Primer sequence
cttcgtgcccttgccratkatraabacg

SEQ ID NO: 263 - DNA, 26 bp, Artificial sequence
  Primer sequence
  misc_feature (18)..(18): n is a, c, g, or t
tcggtcttctcgaagacntaygtkac

SEQ ID NO: 264 - DNA, 27 bp, Artificial sequence
  Primer sequence
ccctggttcttcttvrrrttcttcctc

SEQ ID NO: 265 - DNA, 26 bp, Artificial sequence
  Primer sequence
tgcgatgcggcaaraaraaggtbtgg

SEQ ID NO: 266 - DNA, 26 bp, Artificial sequence
  Primer sequence
tcctgcttcttsgyrgcratwcgytc

SEQ ID NO: 267 - DNA, 25 bp, Artificial sequence
  Primer sequence
ctctcaaggattckytrcaratgtc

SEQ ID NO: 268 - DNA, 23 bp, Artificial sequence
  Primer sequence
cgccattgggcratggtytckcc

SEQ ID NO: 269 - DNA, 22 bp, Artificial sequence
  Primer sequence
cgcagatcaarcayatgatggc

SEQ ID NO: 270 - DNA, 21 bp, Artificial sequence
  Primer sequence
cggatctcgggcasmarytgc

SEQ ID NO: 271 - DNA, 24 bp, Artificial sequence
  Primer sequence
gactgtgtctggtgtraacggwcc

SEQ ID NO: 272 - DNA, 24 bp, Artificial sequence
  Primer sequence
ggaataggatgggtratrtcgtcg

SEQ ID NO: 273 - DNA, 23 bp, Artificial sequence
  Primer sequence
gggccaagcacwsygaaatrcag

SEQ ID NO: 274 - DNA, 23 bp, Artificial sequence
  Primer sequence
tgtgccaccctagtrcgrtgytc

SEQ ID NO: 275 - DNA, 23 bp, Phaedon cochleariae
aaaattgtcatgcaaaggttgat

SEQ ID NO: 276 - DNA, 21 bp, Phaedon cochleariae
aaagcatggatgttggacaaa

SEQ ID NO: 277 - DNA, 23 bp, Phaedon cochleariae
aaagcatggatgttggacaaatt

SEQ ID NO: 278 - DNA, 26 bp, Phaedon cochleariae
aaagcatggatgttggacaaattggg

SEQ ID NO: 279 - DNA, 32 bp, Phaedon cochleariae
aaagcatggatgttggacaaattggggggtgt

SEQ ID NO: 280 - DNA, 22 bp, Phaedon cochleariae
aaatacaagttgtgtaaagtaa

SEQ ID NO: 281 - DNA, 31 bp, Phaedon cochleariae
aagcatggatgttggacaaattggggggtgt

SEQ ID NO: 282 - DNA, 23 bp, Phaedon cochleariae
atggatgtcattactattgagaa

SEQ ID NO: 283 - DNA, 24 bp, Phaedon cochleariae
catcaaatttgaatctggcaacct

SEQ ID NO: 284 - DNA, 23 bp, Phaedon cochleariae
catgatggcagaaccattcgtta

SEQ ID NO: 285 - DNA, 22 bp, Phaedon cochleariae
ccaaagcatggatgttggacaa

SEQ ID NO: 286 - DNA, 23 bp, Phaedon cochleariae
ccatttttggtaacacatgatgg

SEQ ID NO: 287 - DNA, 23 bp, Phaedon cochleariae
cccaaagcatggatgttggacaa

SEQ ID NO: 288 - DNA, 24 bp, Phaedon cochleariae
cccaaagcatggatgttggacaaa

SEQ ID NO: 289 - DNA, 26 bp, Phaedon cochleariae
cccaaagcatggatgttggacaaatt

SEQ ID NO: 290 - DNA, 29 bp, Phaedon cochleariae
cccaaagcatggatgttggacaaattggg

SEQ ID NO: 291 - DNA, 35 bp, Phaedon cochleariae
cccaaagcatggatgttggacaaattggggggtgt

SEQ ID NO: 292 - DNA, 41 bp, Phaedon cochleariae
cccaaagcatggatgttggacaaattggggggtgtcttcgc

SEQ ID NO: 293 - DNA, 23 bp, Phaedon cochleariae
cgttaccctgaccccaacatcaa

SEQ ID NO: 294 - DNA, 25 bp, Phaedon cochleariae
gcaaaatacaagttgtgtaaagtaa

SEQ ID NO: 295 - DNA, 23 bp, Phaedon cochleariae
gcatggatgttggacaaattggg

SEQ ID NO: 296 - DNA, 25 bp, Phaedon cochleariae
gcatggatgttggacaaattggggg

SEQ ID NO: 297 - DNA, 29 bp, Phaedon cochleariae
gcatggatgttggacaaattggggggtgt

SEQ ID NO: 298 - DNA, 31 bp, Phaedon cochleariae
gcatggatgttggacaaattggggggtgtct

SEQ ID NO: 299 - DNA, 23 bp, Phaedon cochleariae
gctcccaaagcatggatgttgga

SEQ ID NO: 300 - DNA, 26 bp, Phaedon cochleariae
gctcccaaagcatggatgttggacaa

SEQ ID NO: 301 - DNA, 27 bp, Phaedon cochleariae
gctcccaaagcatggatgttggacaaa

SEQ ID NO: 302 - DNA, 32 bp, Phaedon cochleariae
gctcccaaagcatggatgttggacaaattggg

SEQ ID NO: 303 - DNA, 26 bp, Phaedon cochleariae
ggtcccaaaggaatcccatttttggt

SEQ ID NO: 304 - DNA, 21 bp, Phaedon cochleariae
ggtgtcttcgcccctcgtcca

SEQ ID NO: 305 - DNA, 28 bp, Phaedon cochleariae
gtgaagtcactaaaattgtcatgcaaag

SEQ ID NO: 306 - DNA, 23 bp, Phaedon cochleariae
tccaccgggcctcacaagttgcg

SEQ ID NO: 307 - DNA, 21 bp, Phaedon cochleariae
tcccaaagcatggatgttgga

SEQ ID NO: 308 - DNA, 27 bp, Phaedon cochleariae
tgctcccaaagcatggatgttggacaa

SEQ ID NO: 309 - DNA, 28 bp, Phaedon cochleariae
tggatgttggacaaattggggggtgtct

SEQ ID NO: 310 - DNA, 21 bp, Phaedon cochleariae
aaaattgaagatttcttggaa

SEQ ID NO: 311 - DNA, 23 bp, Phaedon cochleariae
aacaaacgtgaagtgtggagagt

SEQ ID NO: 312 - DNA, 23 bp, Phaedon cochleariae
aagtcgcccttcgggggtggccg

SEQ ID NO: 313 - DNA, 25 bp, Phaedon cochleariae
acttctccctgaagtcgcccttcgg

SEQ ID NO: 314 - DNA, 26 bp, Phaedon cochleariae
agattgtttgaaggtaatgcacttct

SEQ ID NO: 315 - DNA, 21 bp, Phaedon cochleariae
atccgtaaagctgctcgtgaa

SEQ ID NO: 316 - DNA, 23 bp, Phaedon cochleariae
atcgacttctccctgaagtcgcc

SEQ ID NO: 317 - DNA, 25 bp, Phaedon cochleariae
atcgacttctccctgaagtcgccct

SEQ ID NO: 318 - DNA, 51 bp, Phaedon cochleariae
atgaagcttgattatgttttgggtctgaaaattgaagatttcttggaaaga

SEQ ID NO: 319 - DNA, 21 bp, Phaedon cochleariae
attgaagatttcttggaaaga

SEQ ID NO: 320 - DNA, 23 bp, Phaedon cochleariae
cacatcgacttctccctgaagtc

SEQ ID NO: 321 - DNA, 38 bp, Phaedon cochleariae
cagaagcacatcgacttctccctgaagtcgcccttcgg

SEQ ID NO: 322 - DNA, 41 bp, Phaedon cochleariae
cagaagcacatcgacttctccctgaagtcgcccttcggggg

SEQ ID NO: 323 - DNA, 21 bp, Phaedon cochleariae
cgacttctccctgaagtcgcc

SEQ ID NO: 324 - DNA, 21 bp, Phaedon cochleariae
ctccctgaagtcgcccttcgg

SEQ ID NO: 325 - DNA, 35 bp, Phaedon cochleariae
ctggactcgcagaagcacatcgacttctccctgaa

SEQ ID NO: 326 - DNA, 26 bp, Phaedon cochleariae
gacttctccctgaagtcgcccttcgg

SEQ ID NO: 327 - DNA, 26 bp, Phaedon cochleariae
gctaaaatccgtaaagctgctcgtga

SEQ ID NO: 328 - DNA, 29 bp, Phaedon cochleariae
gctaaaatccgtaaagctgctcgtgaact

SEQ ID NO: 329 - DNA, 26 bp, Phaedon cochleariae
gtgcgcaagcaggtggtgaacatccc

SEQ ID NO: 330 - DNA, 29 bp, Phaedon cochleariae
tacactttggctaaaatccgtaaagctgc

SEQ ID NO: 331 - DNA, 23 bp, Phaedon cochleariae
tcgcagaagcacatcgacttctc

SEQ ID NO: 332 - DNA, 41 bp, Phaedon cochleariae
tcgcagaagcacatcgacttctccctgaagtcgcccttcgg

SEQ ID NO: 333 - DNA, 22 bp, Phaedon cochleariae
tctccctgaagtcgcccttcgg

SEQ ID NO: 334 - DNA, 23 bp, Phaedon cochleariae
tgaaaattgaagatttcttggaa

SEQ ID NO: 335 - DNA, 26 bp, Phaedon cochleariae
tgaaaattgaagatttcttggaaaga

SEQ ID NO: 336 - DNA, 31 bp, Phaedon cochleariae
tggactcgcagaagcacatcgacttctccct

SEQ ID NO: 337 - DNA, 22 bp, Phaedon cochleariae
tggctaaaatccgtaaagctgc

SEQ ID NO: 338 - DNA, 28 bp, Phaedon cochleariae
tgggtctgaaaattgaagatttcttgga

SEQ ID NO: 339 - DNA, 23 bp, Phaedon cochleariae
ttctccctgaagtcgcccttcgg

SEQ ID NO: 340 - DNA, 32 bp, Phaedon cochleariae
ttgggtctgaaaattgaagatttcttggaaag

SEQ ID NO: 341 - DNA, 23 bp, Phaedon cochleariae
gggtgcgcaagcaggtggtgaac

SEQ ID NO: 342 - DNA, 29 bp, Phaedon cochleariae
ctcctcaaaaagtacagggaggccaagaa

SEQ ID NO: 343 - DNA, 23 bp, Phaedon cochleariae
aaaaagaaggtgtggttggatcc

SEQ ID NO: 344 - DNA, 35 bp, Phaedon cochleariae
aaaaagaaggtgtggttggatccaaatgaaatcaa

SEQ ID NO: 345 - DNA, 32 bp, Phaedon cochleariae
aaagaaggtgtggttggatccaaatgaaatca

SEQ ID NO: 346 - DNA, 23 bp, Phaedon cochleariae
aacaccaactcaagacaaaacat

SEQ ID NO: 347 - DNA, 29 bp, Phaedon cochleariae
aacaccaactcaagacaaaacatccgtaa

SEQ ID NO: 348 - DNA, 23 bp, Phaedon cochleariae
aactcaagacaaaacatccgtaa

SEQ ID NO: 349 - DNA, 38 bp, Phaedon cochleariae
aagaacactgaagccagaaggaagggaaggcattgtgg

SEQ ID NO: 350 - DNA, 26 bp, Phaedon cochleariae
aatgaaatcaacgaaatcgccaacac

SEQ ID NO: 351 - DNA, 26 bp, Phaedon cochleariae
atggagtacatccacaagaagaaggc

SEQ ID NO: 352 - DNA, 21 bp, Phaedon cochleariae
caagatgctgtctgaccaggc

SEQ ID NO: 353 - DNA, 26 bp, Phaedon cochleariae
cgcctcctcaaaaagtacagggaggc

SEQ ID NO: 354 - DNA, 21 bp, Phaedon cochleariae
cgtatcgccaccaagaagcag

SEQ ID NO: 355 - DNA, 23 bp, Phaedon cochleariae
ctgtacatgaaagcgaagggtaa

SEQ ID NO: 356 - DNA, 22 bp, Phaedon cochleariae
gaacaagagggtccttatggag

SEQ ID NO: 357 - DNA, 30 bp, Phaedon cochleariae
gaacaagagggtccttatggagtacatcca

SEQ ID NO: 358 - DNA, 23 bp, Phaedon cochleariae
gagcgtatcgccaccaagaagca

SEQ ID NO: 359 - DNA, 23 bp, Phaedon cochleariae
gagtacatccacaagaagaaggc

SEQ ID NO: 360 - DNA, 23 bp, Phaedon cochleariae
gatccaaatgaaatcaacgaaat

SEQ ID NO: 361 - DNA, 29 bp, Phaedon cochleariae
gccaacaccaactcaagacaaaacatccg

SEQ ID NO: 362 - DNA, 38 bp, Phaedon cochleariae
gccaacaccaactcaagacaaaacatccgtaagctcat

SEQ ID NO: 363 - DNA, 37 bp, Phaedon cochleariae
ggcaaaaagaaggtgtggttggatccaaatgaaatca

SEQ ID NO: 364 - DNA, 28 bp, Phaedon cochleariae
gggtccttatggagtacatccacaagaa

SEQ ID NO: 365 - DNA, 22 bp, Phaedon cochleariae
tgcgatgcggcaaaaagaaggt

SEQ ID NO: 366 - DNA, 29 bp, Phaedon cochleariae
tggttggatccaaatgaaatcaacgaaat

SEQ ID NO: 367 - DNA, 26 bp, Phaedon cochleariae
ttggatccaaatgaaatcaacgaaat

SEQ ID NO: 368 - DNA, 21 bp, Phaedon cochleariae
ccgcagttcatgtaccatttg

SEQ ID NO: 369 - DNA, 29 bp, Phaedon cochleariae
ctgatggagatgaagcagtgctgcaattc

SEQ ID NO: 370 - DNA, 23 bp, Phaedon cochleariae
gacgtgctcagatgggtggacag

SEQ ID NO: 371 - DNA, 21 bp, Phaedon cochleariae
gcccgagcctgtgttgttgga

SEQ ID NO: 372 - DNA, 23 bp, Phaedon cochleariae
ggcacatgctgatgcgtgaggat

SEQ ID NO: 373 - DNA, 23 bp, Phaedon cochleariae
gggcacatggtcatgggcgattc

SEQ ID NO: 374 - DNA, 23 bp, Phaedon cochleariae
aagatcatggagtactacgagaa

SEQ ID NO: 375 - DNA, 21 bp, Phaedon cochleariae
acgagaaaaaggagaagcaag

SEQ ID NO: 376 - DNA, 32 bp, Phaedon cochleariae
atggagtactacgagaaaaaggagaagcaagt

SEQ ID NO: 377 - DNA, 26 bp, Phaedon cochleariae
caaaaacaaatcaaacacatgatggc

SEQ ID NO: 378 - DNA, 23 bp, Phaedon cochleariae
ctcaagatcatggagtactacga

SEQ ID NO: 379 - DNA, 26 bp, Phaedon cochleariae
ctcaagatcatggagtactacgagaa

SEQ ID NO: 380 - DNA, 23 bp, Phaedon cochleariae
gaacaagaagccaatgagaaagc

SEQ ID NO: 381 - DNA, 21 bp, Phaedon cochleariae
gactcaagatcatggagtact

SEQ ID NO: 382 - DNA, 32 bp, Phaedon cochleariae
gatgttcaaaaacaaatcaaacacatgatggc

SEQ ID NO: 383 - DNA, 22 bp, Phaedon cochleariae
tactacgagaaaaaggagaagc

SEQ ID NO: 384 - DNA, 23 bp, Phaedon cochleariae
ttcattgaacaagaagccaatga

SEQ ID NO: 385 - DNA, 23 bp, Phaedon cochleariae
acacgaccggcgcgctcgtaaat

SEQ ID NO: 386 - DNA, 41 bp, Phaedon cochleariae
accagcacgtgcttctcgcactggtaggccaagaattcggc

SEQ ID NO: 387 - DNA, 26 bp, Phaedon cochleariae
agcacgtgcttctcgcactggtaggc

SEQ ID NO: 388 - DNA, 23 bp, Phaedon cochleariae
atacgcgaccacgggttgatcgg

SEQ ID NO: 389 - DNA, 27 bp, Phaedon cochleariae
atcggtgtacatgtaaccggggaaacc

SEQ ID NO: 390 - DNA, 24 bp, Phaedon cochleariae
atcgttggccaagttcaagaacag

SEQ ID NO: 391 - DNA, 30 bp, Phaedon cochleariae
cacgtgcttctcgcactggtaggccaagaa

SEQ ID NO: 392 - DNA, 23 bp, Phaedon cochleariae
ccagtctggatcatttcctcggg

SEQ ID NO: 393 - DNA, 26 bp, Phaedon cochleariae
ccagtctggatcatttcctcgggata

SEQ ID NO: 394 - DNA, 37 bp, Phaedon cochleariae
cgctcgatggtcggatcgttggccaagttcaagaaca

SEQ ID NO: 395 - DNA, 53 bp, Phaedon cochleariae
cgctcgatggtcggatcgttggccaagttcaagaacagacacacgttctccat

SEQ ID NO: 396 - DNA, 28 bp, Phaedon cochleariae
cgtgcttctcgcactggtaggccaagaa

SEQ ID NO: 397 - DNA, 29 bp, Phaedon cochleariae
ctggcagtttccatgttgacacccatagc

SEQ ID NO: 398 - DNA, 21 bp, Phaedon cochleariae
cttagcatcaatacctgatgt

SEQ ID NO: 399 - DNA, 29 bp, Phaedon cochleariae
gacatgtcggtcaagatgaccagcacgtg

SEQ ID NO: 400 - DNA, 41 bp, Phaedon cochleariae
gacatgtcggtcaagatgaccagcacgtgcttctcgcactg

SEQ ID NO: 401 - DNA, 44 bp, Phaedon cochleariae
gacatgtcggtcaagatgaccagcacgtgcttctcgcactggta

SEQ ID NO: 402 - DNA, 23 bp, Phaedon cochleariae
gagccgttctcttcgaagtcctg

SEQ ID NO: 403 - DNA, 21 bp, Phaedon cochleariae
gatgaccagcacgtgcttctc

SEQ ID NO: 404 - DNA, 27 bp, Phaedon cochleariae
gatgaccagcacgtgcttctcgcactg

SEQ ID NO: 405 - DNA, 39 bp, Phaedon cochleariae
gatgaccagcacgtgcttctcgcactggtaggccaagaa

SEQ ID NO: 406 - DNA, 45 bp, Phaedon cochleariae
gatgaccagcacgtgcttctcgcactggtaggccaagaattcggc

SEQ ID NO: 407 - DNA, 21 bp, Phaedon cochleariae
gatggggatctgcgtgatgga

SEQ ID NO: 408 - DNA, 39 bp, Phaedon cochleariae
gatggggatctgcgtgatggagccgttgcggccctccac

SEQ ID NO: 409 - DNA, 35 bp, Phaedon cochleariae
ggaataggatgggtgatgtcgtcgttgggcatagt

SEQ ID NO: 410 - DNA, 37 bp, Phaedon cochleariae
ggaataggatgggtgatgtcgtcgttgggcatagtca

SEQ ID NO: 411 - DNA, 23 bp, Phaedon cochleariae
ggatcgttggccaagttcaagaa

SEQ ID NO: 412 - DNA, 25 bp, Phaedon cochleariae
ggatcgttggccaagttcaagaaca

SEQ ID NO: 413 - DNA, 26 bp, Phaedon cochleariae
ggatcgttggccaagttcaagaacag

SEQ ID NO: 414 - DNA, 26 bp, Phaedon cochleariae
ggatgggtgatgtcgtcgttgggcat

SEQ ID NO: 415 - DNA, 27 bp, Phaedon cochleariae
ggcagtttccatgttgacacccatagc

SEQ ID NO: 416 - DNA, 23 bp, Phaedon cochleariae
ggcatagtcaagatggggatctg

SEQ ID NO: 417 - DNA, 23 bp, Phaedon cochleariae
gtctggatcatttcctcgggata

SEQ ID NO: 418 - DNA, 62 bp, Phaedon cochleariae
gtgatgatgcgctcgatggtcggatcgttggccaagttcaagaacagacacacgttctccat

SEQ ID NO: 419 - DNA, 23 bp, Phaedon cochleariae
gtgtacatgtaaccggggaaacc

SEQ ID NO: 420 - DNA, 23 bp, Phaedon cochleariae
gtttccatgttgacacccatagc

SEQ ID NO: 421 - DNA, 26 bp, Phaedon cochleariae
tcaatgggttttcctgatccattgaa

SEQ ID NO: 422 - DNA, 22 bp, Phaedon cochleariae
tcatccagcacagacttgccag

SEQ ID NO: 423 - DNA, 23 bp, Phaedon cochleariae
tcatccagcacagacttgccagg

SEQ ID NO: 424 - DNA, 23 bp, Phaedon cochleariae
tccatgttgacacccatagcagc

SEQ ID NO: 425 - DNA, 29 bp, Phaedon cochleariae
tccatgttgacacccatagcagcaaacac

SEQ ID NO: 426 - DNA, 26 bp, Phaedon cochleariae
tcgaagtcctgcttgaagaacctggc

SEQ ID NO: 427 - DNA, 50 bp, Phaedon cochleariae
tcgatggtcggatcgttggccaagttcaagaacagacacacgttctccat

SEQ ID NO: 428 - DNA, 43 bp, Phaedon cochleariae
tcggatcgttggccaagttcaagaacagacacacgttctccat

SEQ ID NO: 429 - DNA, 23 bp, Phaedon cochleariae
tcgttggccaagttcaagaacag

SEQ ID NO: 430 - DNA, 23 bp, Phaedon cochleariae
tgggtgatgtcgtcgttgggcat

SEQ ID NO: 431 - DNA, 23 bp, Phaedon cochleariae
ttctcgcactggtaggccaagaa

SEQ ID NO: 432 - DNA, 32 bp, Phaedon cochleariae
ttctcttcgaagtcctgcttgaagaacctggc

SEQ ID NO: 433 - DNA, 29 bp, Phaedon cochleariae
ttggccaagttcaagaacagacacacgtt

SEQ ID NO: 434 - DNA, 29 bp, Phaedon cochleariae
gtttccatgttgacacccatagcagcaaa

SEQ ID NO: 435 - DNA, 21 bp, Phaedon cochleariae
atggatgttggacaaattggg

SEQ ID NO: 436 - DNA, 29 bp, Phaedon cochleariae
gctaaaatccgtaaagctgctcgtgaact

SEQ ID NO: 437 - DNA, 23 bp, Phaedon cochleariae
gagtaaagtacactttggctaaa

SEQ ID NO: 438 - DNA, 26 bp, Phaedon cochleariae
aaaatccgtaaagctgctcgtgaact

SEQ ID NO: 439 - DNA, 26 bp, Phaedon cochleariae
ctggactcgcagaagcacatcgactt

SEQ ID NO: 440 - DNA, 21 bp, Phaedon cochleariae
cgtctggatcaggaattgaaa

SEQ ID NO: 441 - DNA, 23 bp, Phaedon cochleariae
tggttggatccaaatgaaatcaa

SEQ ID NO: 442 - DNA, 26 bp, Phaedon cochleariae
gtgtggttggatccaaatgaaatcaa

SEQ ID NO: 443 - DNA, 29 bp, Phaedon cochleariae
cacatgatggctttcattgaacaagaagc

SEQ ID NO: 444 - DNA, 23 bp, Phaedon cochleariae
tacgagaaaaaggagaagcaagt

SEQ ID NO: 445 - DNA, 26 bp, Phaedon cochleariae
gtctggatcatttcctcgggataaat

SEQ ID NO: 446 - DNA, 26 bp, Phaedon cochleariae
ccagtctggatcatttcctcgggata

SEQ ID NO: 447 - DNA, 24 bp, Phaedon cochleariae
ccctgctggtttcatggatgtcat

SEQ ID NO: 448 - DNA, 23 bp, Phaedon cochleariae
attgaagatttcttggaaagaag

SEQ ID NO: 449 - DNA, 22 bp, Phaedon cochleariae
ttgaagatttcttggaaagaag

SEQ ID NO: 450 - DNA, 22 bp, Phaedon cochleariae
cttctttccaagaaatcttcaa

SEQ ID NO: 451 - DNA, 23 bp, Phaedon cochleariae
gactcgcagaagcacatcgactt

SEQ ID NO: 452 - DNA, 24 bp, Phaedon cochleariae
gactcgcagaagcacatcgacttc

SEQ ID NO: 453 - DNA, 21 bp, Phaedon cochleariae
tcgcagaagcacatcgacttc

SEQ ID NO: 454 - DNA, 23 bp, Phaedon cochleariae
cagaagcacatcgacttctccct

SEQ ID NO: 455 - DNA, 21 bp, Phaedon cochleariae
cttatggagtacatccacaag

SEQ ID NO: 456 - DNA, 22 bp, Phaedon cochleariae
aagaagaaggcagagaaggcca

SEQ ID NO: 457 - DNA, 23 bp, Phaedon cochleariae
gtgttcaataattctcctgatga

SEQ ID NO: 458 - DNA, 23 bp, Phaedon cochleariae
attttccatggagagaccattgc

SEQ ID NO: 459 - DNA, 21 bp, Phaedon cochleariae
gggcagaatccccaagctgcc

SEQ ID NO: 460 - DNA, 21 bp, Phaedon cochleariae
aatacaaggacgccaccggca

SEQ ID NO: 461 - DNA, 23 bp, Phaedon cochleariae
atgcccaacgacgacatcaccca

SEQ ID NO: 462 - DNA, 23 bp, Phaedon cochleariae
tgggtgatgtcgtcgttgggcat

SEQ ID NO: 463 - DNA, 23 bp, Phaedon cochleariae
ggtttccccggttacatgtacac

SEQ ID NO: 464 - DNA, 23 bp, Phaedon cochleariae
actatgcccaacgacgacatcac

SEQ ID NO: 465 - DNA, 23 bp, Phaedon cochleariae
ccgggcacttcttctcgagcggc

SEQ ID NO: 466 - DNA, 23 bp, Phaedon cochleariae
ccgaccatcgagcgcatcatcac

SEQ ID NO: 467 - DNA, 23 bp, Phaedon cochleariae
ttcttgaacttggccaacgatcc

SEQ ID NO: 468 - DNA, 22 bp, Phaedon cochleariae
tgttcttgaacttggccaacga

SEQ ID NO: 469 - DNA, 26 bp, Phaedon cochleariae
gctatgggtgtcaacatggaaactgc

SEQ ID NO: 470 - DNA, 21 bp, Phaedon cochleariae
tgctatgggtgtcaacatgga

SEQ ID NO: 471 - DNA, 25 bp, Phaedon cochleariae
ctattgtgtttgctgctatgggtgt

SEQ ID NO: 472 - DNA, 23 bp, Phaedon cochleariae
tacgagcgcgccggtcgtgtgga

SEQ ID NO: 473 - DNA, 483 bp, Phaedon cochleariae
gcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatct

SEQ ID NO: 474 - DNA, 23 bp, Artificial sequence
  Primer sequence
gcatggatgttggacaaattggg

SEQ ID NO: 475 - DNA, 54 bp, Artificial sequence
  Primer sequence
gcgtaatacgactcactataggagattcaaatttgatgtagtcaagaattttag

SEQ ID NO: 476 - DNA, 45 bp, Artificial sequence
  Primer sequence
gcgtaatacgactcactatagggcatggatgttggacaaattggg

SEQ ID NO: 477 - DNA, 32 bp, Artificial sequence
  Primer sequence
agattcaaatttgatgtagtcaagaattttag

SEQ ID NO: 478 - DNA, 477 bp, Phaedon cochleariae; identical to SEQ ID NO: 249

SEQ ID NO: 479 - DNA, 26 bp, Artificial sequence
  Primer sequence
ccctagacgtccctatgaaaaggccc

SEQ ID NO: 480 - DNA, 45 bp, Artificial sequence
  Primer sequence
gcgtaatacgactcactataggttgacacggccaggtcggccacc

SEQ ID NO: 481 - DNA, 48 bp, Phaedon cochleariae
gcgtaatacgactcactataggccctagacgtccctatgaaaaggccc

SEQ ID NO: 482 - DNA, 23 bp, Artificial sequence
  Primer sequence
ttgacacggccaggtcggccacc

SEQ ID NO: 483 - DNA, 449 bp, Phaedon cochleariae
atcctaatgaaatcaacgaaatcgccaacaccaactcaagacaaaacatccgtaagctcatcaaggatggtcttatcatcaagaagccagtggcagtacactctagggcccgtgtacgcaagaacactgaagctagaaggaagggaaggcattgtggatttggaaagaggaagggtacggcaaatgcccgtatgcctcaaaaggaactgtgggtgcagcgcatgcgcgtcctcaggcgcctcctcaaaaagtacagggaggccaagaaaatcgaccgccatctttaccacgccctgtacatgaaagcgaagggtaacgtgttcaggaacaagagggtccttatggagtacatccacaagaagaaggcagagaaggccagggccaagatgctgtctgaccaggctaacgccaggagattgaaggtgaagcaggccagggaacgtagggaa

SEQ ID NO: 484 - DNA, 26 bp, Artificial sequence
  Primer sequence
atcctaatgaaatcaacgaaatcgcc

SEQ ID NO: 485 - DNA, 47 bp, Artificial sequence
  Primer sequence
gcgtaatacgactcactataggttccctacgttccctggcctgcttc

SEQ ID NO: 486 - DNA, 48 bp, Artificial sequence
  Primer sequence
gcgtaatacgactcactataggatcctaatgaaatcaacgaaatcgcc

SEQ ID NO: 487 - DNA, 25 bp, Artificial sequence
  Primer sequence
ttccctacgttccctggcctgcttc

SEQ ID NO: 488 - DNA, 1546 bp, Phaedon cochleariae
gctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccat

SEQ ID NO: 489 - DNA, 24 bp, Artificial sequence
  Primer sequence
gctcagcctattaccgcccaacgc

SEQ ID NO: 490 - DNA, 48 bp, Artificial sequence
  Primer sequence
gcgtaatacgactcactataggatggaaaatgagtatctggaagaaag

SEQ ID NO: 491 - DNA, 46 bp, Artificial sequence
  Primer sequence
gcgtaatacgactcactatagggctcagcctattaccgcccaacgc

SEQ ID NO: 492 - DNA, 26 bp, Artificial sequence
  Primer sequence
atggaaaatgagtatctggaagaaag

SEQ ID NO: 493 - DNA, 598 bp, Phaedon cochleariae; identical to SEQ ID NO: 255

SEQ ID NO: 494 - DNA, 29 bp, Artificial sequence
  Primer sequence
ctgatgttcaaaaacaaatcaaacacatg

SEQ ID NO: 495 - DNA, 49 bp, Artificial sequence
  Primer sequence
gcgtaatacgactcactataggtgagcgatcagatccaacctagcctcc

SEQ ID NO: 496 - DNA, 51 bp, Artificial sequence
  Primer sequence
gcgtaatacgactcactataggctgatgttcaaaaacaaatcaaacacatg

SEQ ID NO: 497 - DNA, 27 bp, Artificial sequence
  Primer sequence
tgagcgatcagatccaacctagcctcc

SEQ ID NO: 498 - DNA, 909 bp, Phaedon cochleariae
actggtcattcttgaggatgtcaagtttccaaaattcaatgaaattgtccagctcaaattggcagatggaactctacgatctggacaagttttggaagtcagtggatcaaaggcagttgttcaggtatttgaaggcacatcaggtattgatgctaagaacacggtgtgtgagttcactggagatattctaagaactccagtatcagaagatatgctgggacgtgtcttcaatggatcaggaaaacccattgataaaggtcccccgatcctggctgaggactacctcgacatccaaggacagccgatcaacccgtggtcgcgtatttatcccgaggaaatgatccagactgggatcacggccatcgacgtgatgaactctatcgccagagggcagaagattccgatcttctccgccgctgggctgccccacaatgagattgcagcccagatttgtaggcaggctggcttggtcaaagtacctggcaagtctgtgctggatgaccatgaagacaactttgctattgtgtttgctgctatgggtgtcaacatggaaactgccaggttcttcaagcaggacttcgaagagaacggctcgatggagaacgtgtgtctgttcttgaacttggccaacgatccgaccatcgagcgcatcatcacgccgcgtttggctctgacggccgccgaattcttggcctaccagtgcgagaagcacgtgctggtcatcttgaccgacatgtcgtcgtacgcggaggcgttgcgtgaggtgtctgccgctcgagaagaagtgcccggccgtaggggtttccccggttacatgtacaccgatctggccaccatttacgagcgcgccggtcgtgtggagggccgcaacggctccatcacgcagatccccatcttgactatgcccaa

SEQ ID NO: 499 - DNA, 26 bp, Artificial sequence
  Primer sequence
actggtcattcttgaggatgtcaagt

SEQ ID NO: 500 - DNA, 49 bp, Artificial sequence
  Primer sequence
gcgtaatacgactcactataggttgggcatagtcaagatggggatctgc

SEQ ID NO: 501 - DNA, 48 bp, Artificial sequence
  Primer sequence
gcgtaatacgactcactataggactggtcattcttgaggatgtcaagt

SEQ ID NO: 502 - DNA, 27 bp, Artificial sequence
  Primer sequence
ttgggcatagtcaagatggggatctgc

SEQ ID NO: 503 - DNA, 877 bp, Phaedon cochleariae
  misc_feature (788)..(788): n is a, c, g, or t
caagctaacttgaaagtactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtttctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgctgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcnaattgctattatctgtactcgaatatcagactgcagtcatgcgacgagacttcccaacggctgatcgagtattgccttcaattccaaaa

SEQ ID NO: 504 - DNA, 29 bp, Artificial sequence
  Primer sequence
caagctaacttgaaagtactaccagaagg

SEQ ID NO: 505 - DNA, 51 bp, Artificial sequence
  Primer sequence
gcgtaatacgactcactataggttttggaattgaaggcaatactcgatcag

SEQ ID NO: 506 - DNA, 51 bp, Artificial sequence
  Primer sequence
gcgtaatacgactcactataggcaagctaacttgaaagtactaccagaagg

SEQ ID NO: 507 - DNA, 29 bp, Artificial sequence
  Primer sequence
ttttggaattgaaggcaatactcgatcag

SEQ ID NO: 508 - DNA, 2478 bp, Phaedon cochleariae
agattcaaatttgatgtagtcaagaattttagatgtagcaatttccatttgaattgtgtcattcactttgatgttggggtcagggtaacgaatggttctgccatcatgtgttaccaaaaatgggattcctttgggaccagtttggactctccttactttacacaacttgtattttgcctcttcagctgtaatacggtgcacagcaaatcttcctttaacatcatagatcagacggaaaaattcaccagtcttctcaatagtaatgacatccatgaaaccagcagggtaattagaatcagtcctcactttaccatcaactttgatcaacctttgcatgacaattttagtgacttcactgtttgtaagggcatacttcagcctgttacgaaggaaaatcactaaaggcagggattcgcgcaacttgtgaggcccggtggatggacgaggggcgaagacaccccccaatttgtccaacatccatgcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgcatggatgttggacaaattggggggtgtcttcgcccctcgtccatccaccgggcctcacaagttgcgcgaatccctgcctttagtgattttccttcgtaacaggctgaagtatgcccttacaaacagtgaagtcactaaaattgtcatgcaaaggttgatcaaagttgatggtaaagtgaggactgattctaattaccctgctggtttcatggatgtcattactattgagaagactggtgaatttttccgtctgatctatgatgttaaaggaagatttgctgtgcaccgtattacagctgaagaggcaaaatacaagttgtgtaaagtaaggagagtccaaactggtcccaaaggaatcccatttttggtaacacatgatggcagaaccattcgttaccctgaccccaacatcaaagtgaatgacacaattcaaatggaaattgctacatctaaaattcttgactacatcaaatttgaatct

SEQ ID NO: 509 - DNA, 4700 bp, Phaedon cochleariae
ctctcaaggattctttgcagatgtcgctcagcctattaccgcccaacgcgttgattggattgatcacgttcggaaaaatggtgcaagtccacgaactgggtaccgaaggctgcagcaagtcgtacgtgttctgtggaacgaaagatctcaccgccaagcaagtccaggagatgttgggcattggaaaagggtcaccaaatccccaacaacagccagggcaacctgggcggccagggcagaatccccaagctgcccctgtaccaccggggagcagattcttgcagcccgtgtcaaaatgcgacatgaacttgacagatctgatcggggagttgcagaaagacccttggcccgtacatcagggcaaaagacctcttagatccacaggcgcagcattgtccatcgctgtcggcctcttagaatgcacctatccgaatacgggtggcagaatcatgatattcttaggaggaccatgctctcagggtcccggccaggtgttgaacgacgatttgaagcagcccatcaggtcccatcatgacatacacaaagacaatgccaagtacatgaagaaggctatcaaacattacgatcacttggcaatgcgagctgccaccaacagccattgcatcgacatttactcctgcgccctggatcagacgggactgatggagatgaagcagtgctgcaattccaccggagggcacatggtcatgggcgattccttcaattcctctctattcaaacaaaccttccagcgagtgttctcaaaagacccgaagaacgacctcaagatggcgttcaacgccaccttggaggtgaagtgttccagggagttaaaagtccaagggggcatcggctcgtgcgtgtccttgaacgttaaaagccctctggtttccgatacggaactaggcatggggaatactgtgcagtggaaactttgcacgttggcgccgagctctactgtggcgctgttcttcgaggtggttaaccagcattcggcgcccataccacagggaggcaggggctgcatccagctcatcacccagtatcagcacgcgagcgggcaaaggaggatcagagtgaccacgattgctagaaattgggcggacgctactgccaacatccaccacattagcgctggcttcgaccaagaagcggcggcagttgtgatggcccgaatggccggttacaaggcggaatcggacgagactcccgacgtgctcagatgggtggacaggatgttgatcaggctgtgccagaagttcggagagtacaataaagacgatccgaattcgttcaggttgggggagaacttcagtctgtatccgcagttcatgtaccatttgagacggtcgcagtttctgcaggtgttcaataattctcctgatgaaacgtcgttttataggcacatgctgatgcgtgaggatttgactcagtctttgatcatgatccagccgattttgtacagttacagcttcaacgggccgcccgagcctgtgttgttggacacaagctctattcagccggatagaatcctgctcatggacactttcttccagatactcattttccatggagagaccattgcccaatggcgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcgccattgggcaatggtctctccatggaaaatgagtatctggaagaaagtgtccatgagcaggattctatccggctgaatagagcttgtgtccaacaacacaggctcgggcggcccgttgaagctgtaactgtacaaaatcggctggatcatgatcaaagactgagtcaaatcctcacgcatcagcatgtgcctataaaacgacgtttcatcaggagaattattgaacacctgcagaaactgcgaccgtctcaaatggtacatgaactgcggatacagactgaagttctcccccaacctgaacgaattcggatcgtctttattgtactctccgaacttctggcacagcctgatcaacatcctgtccacccatctgagcacgtcgggagtctcgtccgattccgccttgtaaccggccattcgggccatcacaactgccgccgcttcttggtcgaagccagcgctaatgtggtggatgttggcagtagcgtccgcccaatttctagcaatcgtggtcactctgatcctcctttgcccgctcgcgtgctgatactgggtgatgagctggatgcagcccctgcctccctgtggtatgggcgccgaatgctggttaaccacctcgaagaacagcgccacagtagagctcggcgccaacgtgcaaagtttccactgcacagtattccccatgcctagttccgtatcggaaaccagagggcttttaacgttcaaggacacgcacgagccgatgcccccttggacttttaactccctggaacacttcacctccaaggtggcgttgaacgccatcttgaggtcgttcttcgggtcttttgagaacactcgctggaaggtttgtttgaatagagaggaattgaaggaatcgcccatgaccatgtgccctccggtggaattgcagcactgcttcatctccatcagtcccgtctgatccagggcgcaggagtaaatgtcgatgcaatggctgttggtggcagctcgcattgccaagtgatcgtaatgtttgatagccttcttcatgtacttggcattgtctttgtgtatgtcatgatgggacctgatgggctgcttcaaatcgtcgttcaacacctggccgggaccctgagagcatggtcctcctaagaatatcatgattctgccacccgtattcggataggtgcattctaagaggccgacagcgatggacaatgctgcgcctgtggatctaagaggtcttttgccctgatgtacgggccaagggtctttctgcaactccccgatcagatctgtcaagttcatgtcgcattttgacacgggctgcaagaatctgctccccggtggtacaggggcagcttggggattctgccctggccgcccaggttgccctggctgttgttggggatttggtgacccttttccaatgcccaacatctcctggacttgcttggcggtgagatctttcgttccacagaacacgtacgacttgctgcagccttcggtacccagttcgtggacttgcaccatttttccgaacgtgatcaatccaatcaacgcgttgggcggtaataggctgagcgacatctgcaaagaatccttgagag

SEQ ID NO: 510 - DNA, 2726 bp, Phaedon cochleariae
cgcagatcaaacatatgatggctttcattgaacaagaagccaatgagaaagcagaagaaatcgatgccaaggcagaggaggaattcaacattgaaaaagggcgtttagtccagcaacagagactcaagatcatggagtactacgagaaaaaggagaagcaagtcgaacttcaaaagaaaattcagtcctctaatatgttgaatcaggctcgtttgaaggtgctgaaagtgagagaggaccatgtcagagcagtcctggaggatgctcgtaaaagtcttggtgaagtaaccaaagaccaaggaaaatactcccaaattttggagagcctaatcctacaaggactgttccagctgttcgagaaggaggtgacggtccgcgtgagaccgcaagatagggacttggttaggtccatcctgcccaacgtcgctgccaaatacaaggacgccaccggcaaagacatcctactcaaggtggacgatgagtcgcacctgtctcaggagatcaccggaggcgtcgatctgctcgctcagaagaacaagatcaagatcagcaacacgatggaggctaggttggatctgatcgctcagcaattggtgcccgagatccgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcggatctcgggcaccaattgctgagcgatcagatccaacctagcctccatcgtgttgctgatcttgatcttgttcttctgagcgagcagatcgacgcctccggtgatctcctgagacaggtgcgactcatcgtccaccttgagtaggatgtctttgccggtggcgtccttgtatttggcagcgacgttgggcaggatggacctaaccaagtccctatcttgcggtctcacgcggaccgtcacctccttctcgaacagctggaacagtccttgtaggattaggctctccaaaatttgggagtattttccttggtctttggttacttcaccaagacttttacgagcatcctccaggactgctctgacatggtcctctctcactttcagcaccttcaaacgagcctgattcaacatattagaggactgaattttcttttgaagttcgacttgcttctcctttttctcgtagtactccatgatcttgagtctctgttgctggactaaacgccctttttcaatgttgaattcctcctctgccttggcatcgatttcttctgctttctcattggcttcttgttcaatgaaagccatcatatgtttgatctgcg

SEQ ID NO: 511 - DNA, 3330 bp, Phaedon cochleariae
ttgggcatagtcaagatggggatctgcgtgatggagccgttgcggccctccacacgaccggcgcgctcgtaaatggtggccagatcggtgtacatgtaaccggggaaacccctacggccgggcacttcttctcgagcggcagacacctcacgcaacgcctccgcgtacgacgacatgtcggtcaagatgaccagcacgtgcttctcgcactggtaggccaagaattcggcggccgtcagagccaaacgcggcgtgatgatgcgctcgatggtcggatcgttggccaagttcaagaacagacacacgttctccatcgagccgttctcttcgaagtcctgcttgaagaacctggcagtttccatgttgacacccatagcagcaaacacaatagcaaagttgtcttcatggtcatccagcacagacttgccaggtactttgaccaagccagcctgcctacaaatctgggctgcaatctcattgtggggcagcccagcggcggagaagatcggaatcttctgccctctggcgatagagttcatcacgtcgatggccgtgatcccagtctggatcatttcctcgggataaatacgcgaccacgggttgatcggctgtccttggatgtcgaggtagtcctcagccaggatcgggggacctttatcaatgggttttcctgatccattgaagacacgtcccagcatatcttctgatactggagttcttagaatatctccagtgaactcacacaccgtgttcttagcatcaatacctgatgtgccttcaaatacctgaacaactgcctttgatccactgacttccaaaacttgtccagatcgtagagttccatctgccaatttgagctggacaatttcattgaattttggaaacttgacatcctcaagaatgaccagtaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttactggtcattcttgaggatgtcaagtttccaaaattcaatgaaattgtccagctcaaattggcagatggaactctacgatctggacaagttttggaagtcagtggatcaaaggcagttgttcaggtatttgaaggcacatcaggtattgatgctaagaacacggtgtgtgagttcactggagatattctaagaactccagtatcagaagatatgctgggacgtgtcttcaatggatcaggaaaacccattgataaaggtcccccgatcctggctgaggactacctcgacatccaaggacagccgatcaacccgtggtcgcgtatttatcccgaggaaatgatccagactgggatcacggccatcgacgtgatgaactctatcgccagagggcagaagattccgatcttctccgccgctgggctgccccacaatgagattgcagcccagatttgtaggcaggctggcttggtcaaagtacctggcaagtctgtgctggatgaccatgaagacaactttgctattgtgtttgctgctatgggtgtcaacatggaaactgccaggttcttcaagcaggacttcgaagagaacggctcgatggagaacgtgtgtctgttcttgaacttggccaacgatccgaccatcgagcgcatcatcacgccgcgtttggctctgacggccgccgaattcttggcctaccagtgcgagaagcacgtgctggtcatcttgaccgacatgtcgtcgtacgcggaggcgttgcgtgaggtgtctgccgctcgagaagaagtgcccggccgtaggggtttccccggttacatgtacaccgatctggccaccatttacgagcgcgccggtcgtgtggagggccgcaacggctccatcacgcagatccccatcttgactatgcccaa

SEQ ID NO: 512 - DNA, 3356 bp, Phaedon cochleariae
gggccaagcacagcgaaatgcagcaagctaacttgaaagcactaccagaaggagctgaaatcagagatggagaacgtttgccagtcacagtaaaggacatgggagcatgcgagatttacccacaaacaatccaacacaaccccaatgggcggtttgtagtggtttgtggtgatggagaatacataatatacacggctatggcccttcgtaacaaagcatttggtagcgctcaagaatttgtatgggcacaggactccagtgaatatgccatccgcgaatccggatccaccattcgaatcttcaagaatttcaaagaaaaaaagaatttcaagtccgactttggtgccgaaggaatctatggtggttttctcttgggtgtgaaatcagtgtctggcttagctttctatgactgggaaacgcttgagttagtaaggcgcattgaaatacagcctagagctatctactggtcagatagtggcaagttggtatgccttgctaccgaagatagctatttcatattgtcctatgactctgaccaagtccagaaagctagagataacaaccaagttgccgaagatggagtggaggctgcctttgatgtcctaggtgaaataaatgaatccgtaagaacaggtctttgggtaggagactgcttcatttacacaaacgcagtcaaccgtatcaactactttgtgggtggtgaattggtaactattgcacatctggaccgtcctctatatgtcctgggctatgtacctagagatgacaggttatacttggttgataaagagttaggagtagtcagctatcaattgctattatctgtactcgaatatcagactgcagtcatgcgacgagacttcccaacggctgatcgagtattgccttcaattccaaaagaacaccgcactagggtggcacaaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgccctttgtgccaccctagtgcggtgttcttttggaattgaaggcaatactcgatcagccgttgggaagtctcgtcgcatgactgcagtctgatattcgagtacagataatagcaattgatagctgactactcctaactctttatcaaccaagtataacctgtcatctctaggtacatagcccaggacatatagaggacggtccagatgtgcaatagttaccaattcaccacccacaaagtagttgatacggttgactgcgtttgtgtaaatgaagcagtctcctacccaaagacctgttcttacggattcatttatttcacctaggacatcaaaggcagcctccactccatcttcggcaacttggttgttatctctagctttctggacttggtcagagtcataggacaatatgaaatagctatcttcggtagcaaggcataccaacttgccactatctgaccagtagatagctctaggctgtatttcaatgcgccttactaactcaagcgtttcccagtcatagaaagctaagccagacactgatttcacacccaagagaaaaccaccatagattccttcggcaccaaagtcggacttgaaattctttttttctttgaaattcttgaagattcgaatggtggatccggattcgcggatggcatattcactggagtcctgtgcccatacaaattcttgagcgctaccaaatgctttgttacgaagggccatagccgtgtatattatgtattctccatcaccacaaaccactacaaaccgcccattggggttgtgttggattgtttgtgggtaaatctcgcatgctcccatgtcctttactgtgactggcaaacgttctccatctctgatttcagctccttctggtagtgctttcaagttagcttgctgcatttcgctgtgcttggccc

SEQ ID NO: 513 - DNA, 505 bp, Epilachna varivetis
tgcgatgcggcaagaagaaggtttggctggatcctaatgaaataactgaaattgctaatacaaactctagacaaaacatccgcaaactgattaaagatggtcttattattaaaaagcctgtcgcggtgcattctcgtgcacgtgtacgcaaaaatactgaagcccgcaggaaaggtcgtcattgtggatttggtaaaaggaaaggaactgcaaatgctaggatgcccagaaaggaattatggattcaacgtatgagagttctcagaaggttattgaagaaatatagggaagctaagaaaattgataggcatttataccatgctttatatatgaaagctaagggaaatgtattcaagaataagagagtaatgatggactatatccataaaaagaaggcggagaaagcacgtacaaagatgctcaatgatcaagctgatgcaaggaggctgaaagtcaaagaggcacgtaagcgacgtgaagagcgtatcgctacgaagaagcagga

SEQ ID NO: 514 - protein, 167 aa, Epilachna varivetis
RCGKKKVWLDPNEITEIANTNSRQNIRKLIKDGLIIKKPVAVHSRARVRKNTEARRKGRHCGFGKRKGTANARMPRKELWIQRMRVLRRLLKKYREAKKIDRHLYHALYMKAKGNVFKNKRVMMDYIHKKKAEKARTKMLNDQADARRLKVKEARKRREERIATKKQ

SEQ ID NO: 515 - DNA, 683 bp, Epilachna varivetis
ccaactctcgatccaagcattccaaaatacaggactgaagaatctataataggaacaaacccaggaatgggttttaggccaatgcccgacaacaacgaagaaagtaccctgatttggttacagggttctaataaaacaaactacgaaaaatggaaaatgaatctcctctcatatttagacaagtattacactcccggaaaaatagaaaagggaaatattccagtaaagcgctgttcatacggagaaaaattgattaggggacaagtatgtgatgtagatgtgaggaaatgggagccgtgcaccccggaaaatcattttgattacctcagaaatgcgccttgtatatttctgaagctgaacaggatatatggatgggaaccggagtactacaacgatccaaatgatcttccagatgatatgccgcagcagttgaaggaccatatacgttataatatcaccaatccagtggagagaaataccgtctgggtaacatgcgcaggtgaaaatccggcagacgtggagtacttgggccctgtgaagtattacccatctttccagggattccccggttactattttccatatttgaattctgaagggtacctaagtccattattggcggtacaattcaagagaccggtgtctggtattgttataaatatcgagtgcaaagcgtgggctgc

SEQ ID NO: 516 - protein, 227 aa, Epilachna varivetis
PTLDPSIPKYRTEESIIGTNPGMGFRPMPDNNEESTLIWLQGSNKTNYEKWKMNLLSYLDKYYTPGKIEKGNIPVKRCSYGEKLIRGQVCDVDVRKWEPCTPENHFDYLRNAPCIFLKLNRIYGWEPEYYNDPNDLPDDMPQQLKDHIRYNITNPVERNTVWVTCAGENPADVEYLGPVKYYPSFQGFPGYYFPYLNSEGYLSPLLAVQFKRPVSGIVINIECKAWA

SEQ ID NO: 517 - DNA, 743 bp, Epilachna varivetis
ctggcggccacatggtcatgggtgattcatttaactcttcacttttcaaacaaacatttcaacgagtattttcgaaagattccaatggagacttgaagatgtccttcaacgccatattagaagtgaagtgttctagagaacttaaagtacaaggaggtataggtccttgtgtctctctaaatgtcaaaaatcctcttgtttctgatttagaaataggcatgggtaacacagttcagtggaaactgtgtagcttaagtccaagcactacggttgccttatttttcgaagttgttaatcagcatgcagcacccattcctcaagggggacgtggatgcattcagtttattactcaatatcagcattcaagtggtcagaaaaaaataagggtaactacaatagcaagaaattgggcggatgccactgcaaatattcaccatattagcgctggctttgacgaacaaactgcggctgttttaatggcgaggatcgctgtatatagagcagaaactgatgagagttcagatgttctcagatgggttgacagaatgttgatacgattgtgtcagaaatttggagaatataacaaagatgacaccaacagcttcaggctcagtgaaaacttcagcttatatccacagtttatgtatcatctacgtcgttcccaatttctacaagtgttcaataattcaccagatgaaacttcattctataggcacatgttgatgagggaagatcgcaatcag

SEQ ID NO: 518 - protein, 247 aa, Epilachna varivetis
GGHMVMGDSFNSSLFKQTFQRVFSKDSNGDLKMSFNAILEVKCSRELKVQGGIGPCVSLNVKNPLVSDLEIGMGNTVQWKLCSLSPSTTVALFFEVVNQHAAPIPQGGRGCIQFITQYQHSSGQKKIRVTTIARNWADATANIHHISAGFDEQTAAVLMARIAVYRAETDESSDVLRWVDRMLIRLCQKFGEYNKDDTNSFRLSENFSLYPQFMYHLRRSQFLQVFNNSPDETSFYRHMLMREDRNQ

SEQ ID NO: 519 - DNA, 734 bp, Epilachna varivetis
cgccatccgtcgctgttcaaggcgatcggcgttaagcctccaaggggtattctcctttacgggcctcccggcacggggaaaacgctgatcgccagggccgttgccaacgaaactggtgcgttcttcttcctcatcaatgggcccgagattatgagcaagctggccggagaatccgagagcaatcttagaaaggcttttgaagaggctgataaaaactctcctgcaatcatctttatcgacgaattagacgcaatcgctcccaagcgcgagaagactcatggtgaggtagagagacgcatcgtctcccaactgttgactttgatggacggcatgaagaaaagttcccatgtgatcgtgatggcggccacgaacaggcccaattccatcgaccctgcactcagacgtttcggccgattcgacagagagatcgacatcggtatccccgacgctactggaagattagaagtactcagaatacacaccaaaaacatgaaattggctgacgatgtagatttggaacagattgccgcagagactcacggtcatgtaggtgctgacttggcttctttgtgctcagaggctgccttgcaacaaattagagaaaaaatggacctcatcgacttagatgatgagcagatcgatgccgaagtcctaaattctctggcagttaccatggagaacttccgttacgccatgtctaagagcagtccgagcgctttgcgcgaaaccgtcgt

SEQ ID NO: 520 - protein, 244 aa, Epilachna varivetis
RHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLDDEQIDAEVLNSLAVTMENFRYAMSKSSPSALRETV

SEQ ID NO: 521 - DNA, 799 bp, Epilachna varivetis
gactgtgtctggtgtgaacggaccgttggtgatccttgatagtgttaagtttccaaaatttaacgaaattgtacagctcaagttatcagatggaacagttaggtctggacaagttttggaagtcagtggacagaaggcggttgtccaagtttttgaaggcacctccggaattgatgctaaaaacactttatgtgaatttacaggagatatcttaagaactccagtgtctgaagatatgttgggtcgtgtgtttaatggatctggaaagcctatcgataaagggccgccaatcttagctgaagattttcttgacattcaaggtcaacctataaatccttggtctcgtatctatccagaagaaatgatccagactggtatttctgcgattgatgtgatgaattccattgccagaggacaaaagattccaattttctctgcagctggtttaccccacaatgaaatcgctgctcaaatctgtagacaagctggtcttgtcaaaatcccagggaaatctgtcttagatgatcatgaagacaactttgctatcgttttcgccgctatgggtgtcaatatggaaacagccagattcttcaagcaagattttgaagagaatggctctatggaaaatgtgtgcctatttttgaacttggccaatgatcctaccattgaaagaattataacaccccgtttgactttaacagcggctgaatttatggcatatcaatgtgagaagcatgtgttagtcatattgactgacatgtcatcttatgctgaggctttgcgtgaggtatctgctgct

SEQ ID NO: 522 - protein, 266 aa, Epilachna varivetis
TVSGVNGPLVILDSVKFPKFNEIVQLKLSDGTVRSGQVLEVSGQKAVVQVFEGTSGIDAKNTLCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLTLTAAEFMAYQCEKHVLVILTDMSSYAEALREVSAA

SEQ ID NO: 523 - DNA, 26 bp, Artificial sequence
  Primer sequence
tgcgatgcggcaaraaraaggtbtgg

SEQ ID NO: 524 - DNA, 26 bp, Artificial sequence
  Primer sequence
tcctgcttcttsgyrgcratwcgytc

SEQ ID NO: 525 - DNA, 25 bp, Artificial sequence
  Primer sequence
gggccgtggtcagaayatywayaac

SEQ ID NO: 526 - DNA, 20 bp, Artificial sequence
  Primer sequence
gcagcccacgcyytgcactc

SEQ ID NO: 527 - DNA, 23 bp, Artificial sequence
  Primer sequence
cggctgacgtggaaygtktggcc

SEQ ID NO: 528 - DNA, 24 bp, Artificial sequence
  Primer sequence
cggcgtattctccraayttctggc

SEQ ID NO: 529 - DNA, 21 bp, Artificial sequence
  Primer sequence
cgctgtcgcargcraaratgg

SEQ ID NO: 530 - DNA, 23 bp, Artificial sequence
  Primer sequence
cgatcaaagcgwccraavcgacg

SEQ ID NO: 531 - DNA, 21 bp, Artificial sequence
  Primer sequence
gttcaccggcgayatyctgcg

SEQ ID NO: 532 - DNA, 24 bp, Artificial sequence
  Primer sequence
cggcatagtcagaatsggratctg

SEQ ID NO: 533 - DNA, 23 bp, Epilachna varivetis
aagcgacgtgaagagcgtatcgc

SEQ ID NO: 534 - DNA, 23 bp, Epilachna varivetis
attaaagatggtcttattattaa

SEQ ID NO: 535 - DNA, 26 bp, Epilachna varivetis
cgtaagcgacgtgaagagcgtatcgc

SEQ ID NO: 536 - DNA, 26 bp, Epilachna varivetis
ggtcgtcattgtggatttggtaaaag

SEQ ID NO: 537 - DNA, 22 bp, Epilachna varivetis
tgcgatgcggcaagaagaaggt

SEQ ID NO: 538 - DNA, 21 bp, Epilachna varivetis
tgcggcaagaagaaggtttgg

SEQ ID NO: 539 - DNA, 21 bp, Epilachna varivetis
ttgtggatttggtaaaaggaa

SEQ ID NO: 540 - DNA, 21 bp, Epilachna varivetis
caagtgttcaataattcacca

SEQ ID NO: 541 - DNA, 23 bp, Epilachna varivetis
cattctataggcacatgttgatg

SEQ ID NO: 542 - DNA, 22 bp, Epilachna varivetis
ctggcggccacatggtcatggg

SEQ ID NO: 543 - DNA, 23 bp, Epilachna varivetis
aacaggcccaattccatcgaccc

SEQ ID NO: 544 - DNA, 24 bp, Epilachna varivetis
agagaaaaaatggacctcatcgac

SEQ ID NO: 545 - DNA, 29 bp, Epilachna varivetis
cgccatccgtcgctgttcaaggcgatcgg

SEQ ID NO: 546 - DNA, 36 bp, Epilachna varivetis
ctggcagttaccatggagaacttccgttacgccatg

SEQ ID NO: 547 - DNA, 23 bp, Epilachna varivetis
gtgatcgtgatggcggccacgaa

SEQ ID NO: 548 - DNA, 24 bp, Epilachna varivetis
gtgatcgtgatggcggccacgaac

SEQ ID NO: 549 - DNA, 22 bp, Epilachna varivetis
tgatggacggcatgaagaaaag

SEQ ID NO: 550 - DNA, 23 bp, Epilachna varivetis
aatatggaaacagccagattctt

SEQ ID NO: 551 - DNA, 23 bp, Epilachna varivetis
atgatccagactggtatttctgc

SEQ ID NO: 552 - DNA, 24 bp, Epilachna varivetis
attgatgtgatgaattccattgcc

SEQ ID NO: 553 - DNA, 26 bp, Epilachna varivetis
gaaatgatccagactggtatttctgc

SEQ ID NO: 554 - DNA, 23 bp, Epilachna varivetis
gaagaaatgatccagactggtat

SEQ ID NO: 555 - DNA, 21 bp, Epilachna varivetis
gactgtgtctggtgtgaacgg

SEQ ID NO: 556 - DNA, 23 bp, Epilachna varivetis
gatatgttgggtcgtgtgtttaa

SEQ ID NO: 557 - DNA, 23 bp, Epilachna varivetis
gatcctaccattgaaagaattat

SEQ ID NO: 558 - DNA, 26 bp, Epilachna varivetis
gtgtctgaagatatgttgggtcgtgt

SEQ ID NO: 559 - DNA, 21 bp, Epilachna varivetis
gtgtctggtgtgaacggaccg

SEQ ID NO: 560 - DNA, 23 bp, Epilachna varivetis
tctgaagatatgttgggtcgtgt

SEQ ID NO: 561 - DNA, 22 bp, Epilachna varivetis
tggcatatcaatgtgagaagca

SEQ ID NO: 562 - DNA, 26 bp, Epilachna varivetis
ttgaacttggccaatgatcctaccat

SEQ ID NO: 563 - DNA, 22 bp, Epilachna varivetis
ttaaagatggtcttattattaa

SEQ ID NO: 564 - DNA, 23 bp, Artificial sequence
  Primer sequence
gctatgggtgtcaatatggaaac

SEQ ID NO: 565 - DNA, 23 bp, Artificial sequence
  Primer sequence
ttcaataattcaccagatgaaac

SEQ ID NO: 566 - DNA, 21 bp, Artificial sequence
  Primer sequence
cgatcgccttgaacagcgacg

SEQ ID NO: 567 - DNA, 23 bp, Artificial sequence
  Primer sequence
gttaccatggagaacttccgtta

SEQ ID NO: 568 - DNA, 27 bp, Artificial sequence
  Primer sequence
gttaccatggagaacttccgttacgcc

SEQ ID NO: 569 - DNA, 24 bp, Artificial sequence
  Primer sequence
accatggagaacttccgttacgcc

SEQ ID NO: 570 - DNA, 21 bp, Artificial sequence
  Primer sequence
atggagaacttccgttacgcc

SEQ ID NO: 571 - DNA, 23 bp, Artificial sequence
  Primer sequence
tctgaagatatgttgggtcgtgt

SEQ ID NO: 572 - DNA, 24 bp, Artificial sequence
  Primer sequence
caaaagattccaattttctctgca

SEQ ID NO: 573 - DNA, 26 bp, Artificial sequence
  Primer sequence
ccccacaatgaaatcgctgctcaaat

SEQ ID NO: 574 - DNA, 23 bp, Artificial sequence
  Primer sequence
atcgttttcgccgctatgggtgt

SEQ ID NO: 575 - DNA, 26 bp, Artificial sequence
  Primer sequence
ttcaagcaagattttgaagagaatgg

SEQ ID NO: 576 - DNA, 376 bp, Epilachna varivetis
gacaaaacatccgcaaactgattaaagatggtcttattattaaaaagcctgtcgcggtgcattctcgtgcacgtgtacgcaaaaatactgaagcccgcaggaaaggtcgtcattgtggatttggtaaaaggaaaggaactgcaaatgctaggatgcccagaaaggaattatggattcaacgtatgagagttctcagaaggttattgaagaaatatagggaagctaagaaaattgataggcatttataccatgctttatatatgaaagctaagggaaatgtattcaagaataagagagtaatgatggactatatccataaaaagaaggcggagaaagcacgtacaaagatgctcaatgatcaagctgatgcaaggag

SEQ ID NO: 577 - DNA, 20 bp, Artificial sequence
  Primer sequence
gacaaaacatccgcaaactg

SEQ ID NO: 578 - DNA, 42 bp, Artificial sequence
  Primer sequence
gcgtaatacgactcactataggctccttgcatcagcttgatc

SEQ ID NO: 579 - DNA, 42 bp, Artificial sequence
  Primer sequence
gcgtaatacgactcactatagggacaaaacatccgcaaactg

SEQ ID NO: 580 - DNA, 20 bp, Artificial sequence
  Primer sequence
ctccttgcatcagcttgatc

SEQ ID NO: 581 - DNA, 529 bp, Epilachna varivetis
caggactgaagaatctataataggaacaaacccaggaatgggttttaggccaatgcccgacaacaacgaagaaagtaccctgatttggttacagggttctaataaaacaaactacgaaaaatggaaaatgaatctcctctcatatttagacaagtattacactcccggaaaaatagaaaagggaaatattccagtaaagcgctgttcatacggagaaaaattgattaggggacaagtatgtgatgtagatgtgaggaaatgggagccgtgcaccccggaaaatcattttgattacctcagaaatgcgccttgtatatttctgaagctgaacaggatatatggatgggaaccggagtactacaacgatccaaatgatcttccagatgatatgccgcagcagttgaaggaccatatacgttataatatcaccaatccagtggagagaaataccgtctgggtaacatgcgcaggtgaaaatccggcagacgtggagtacttgggccctgtgaagtattacccatctttccag

SEQ ID NO: 582 - DNA, 24 bp, Artificial sequence
  Primer sequence
caggactgaagaatctataatagg

SEQ ID NO: 583 - DNA, 44 bp, Artificial sequence
  Primer sequence
gcgtaatacgactcactataggctggaaagatgggtaatacttc

SEQ ID NO: 584 - DNA, 46 bp, Artificial sequence
  Primer sequence
gcgtaatacgactcactataggcaggactgaagaatctataatagg

SEQ ID NO: 585 - DNA, 22 bp, Artificial sequence
  Primer sequence
ctggaaagatgggtaatacttc

SEQ ID NO: 586 - DNA, 650 bp, Epilachna varivetis
ccaatggagacttgaagatgtccttcaacgccatattagaagtgaagtgttctagagaacttaaagtacaaggaggtataggtccttgtgtctctctaaatgtcaaaaatcctcttgtttctgatttagaaataggcatgggtaacacagttcagtggaaactgtgtagcttaagtccaagcactacggttgccttatttttcgaagttgttaatcagcatgcagcacccattcctcaagggggacgtggatgcattcagtttattactcaatatcagcattcaagtggtcagaaaaaaataagggtaactacaatagcaagaaattgggcggatgccactgcaaatattcaccatattagcgctggctttgacgaacaaactgcggctgttttaatggcgaggatcgctgtatatagagcagaaactgatgagagttcagatgttctcagatgggttgacagaatgttgatacgattgtgtcagaaatttggagaatataacaaagatgacaccaacagcttcaggctcagtgaaaacttcagcttatatccacagtttatgtatcatctacgtcgttcccaatttctacaagtgttcaataattcaccagatgaaacttcattctataggcacatgttgatgagggaa

SEQ ID NO: 587 - DNA, 650 bp, Artificial sequence; identical to SEQ ID NO: 586
  Primer sequence

SEQ ID NO: 588 - DNA, 42 bp, Artificial sequence
  Primer sequence
gcgtaatacgactcactataggcttccctcatcaacatgtgc

SEQ ID NO: 589 - DNA, 44 bp, Artificial sequence
  Primer sequence
gcgtaatacgactcactataggccaatggagacttgaagatgtc

SEQ ID NO: 590 - DNA, 20 bp, Artificial sequence
  Primer sequence
cttccctcatcaacatgtgc

SEQ ID NO: 591 - DNA, 545 bp, Epilachna varivetis
gttaagcctccaaggggtattctcctttacgggcctcccggcacggggaaaacgctgatcgccagggccgttgccaacgaaactggtgcgttcttcttcctcatcaatgggcccgagattatgagcaagctggccggagaatccgagagcaatcttagaaaggcttttgaagaggctgataaaaactctcctgcaatcatctttatcgacgaattagacgcaatcgctcccaagcgcgagaagactcatggtgaggtagagagacgcatcgtctcccaactgttgactttgatggacggcatgaagaaaagttcccatgtgatcgtgatggcggccacgaacaggcccaattccatcgaccctgcactcagacgtttcggccgattcgacagagagatcgacatcggtatccccgacgctactggaagattagaagtactcagaatacacaccaaaaacatgaaattggctgacgatgtagatttggaacagattgccgcagagactcacggtcatgtaggtgctgacttggcttctttgtgctc

SEQ ID NO: 592 - DNA, 22 bp, Artificial sequence
  Primer sequence
gttaagcctccaaggggtattc

SEQ ID NO: 593 - DNA, 44 bp, Artificial sequence
  Primer sequence
gcgtaatacgactcactatagggagcacaaagaagccaagtcag

SEQ ID NO: 594 - DNA, 44 bp, Artificial sequence
  Primer sequence
gcgtaatacgactcactatagggttaagcctccaaggggtattc

SEQ ID NO: 595 - DNA, 22 bp, Artificial sequence
  Primer sequence
gagcacaaagaagccaagtcag

SEQ ID NO: 596 - DNA, 749 bp, Epilachna varivetis
ggtgatccttgatagtgttaagtttccaaaatttaacgaaattgtacagctcaagttatcagatggaacagttaggtctggacaagttttggaagtcagtggacagaaggcggttgtccaagtttttgaaggcacctccggaattgatgctaaaaacactttatgtgaatttacaggagatatcttaagaactccagtgtctgaagatatgttgggtcgtgtgtttaatggatctggaaagcctatcgataaagggccgccaatcttagctgaagattttcttgacattcaaggtcaacctataaatccttggtctcgtatctatccagaagaaatgatccagactggtatttctgcgattgatgtgatgaattccattgccagaggacaaaagattccaattttctctgcagctggtttaccccacaatgaaatcgctgctcaaatctgtagacaagctggtcttgtcaaaatcccagggaaatctgtcttagatgatcatgaagacaactttgctatcgttttcgccgctatgggtgtcaatatggaaacagccagattcttcaagcaagattttgaagagaatggctctatggaaaatgtgtgcctatttttgaacttggccaatgatcctaccattgaaagaattataacaccccgtttgactttaacagcggctgaatttatggcatatcaatgtgagaagcatgtgttagtcatattgactgacatgtcatcttatgctgagg

SEQ ID NO: 597 - DNA, 22 bp, Artificial sequence
  Primer sequence
ggtgatccttgatagtgttaag

SEQ ID NO: 598 - DNA, 42 bp, Artificial sequence
  Primer sequence
gcgtaatacgactcactataggcctcagcataagatgacatg

SEQ ID NO: 599 - DNA, 44 bp, Artificial sequence
  Primer sequence
gcgtaatacgactcactataggggtgatccttgatagtgttaag

SEQ ID NO: 600 - DNA, 20 bp, Artificial sequence
  Primer sequence
cctcagcataagatgacatg

SEQ ID NO: 601 - DNA, 727 bp, Anthonomus grandis
catttgaagcgttttgctgcccccaaagcatggatgttggacaaattggggggtgtgttcgcccccaggccctccaccgggccacacaagctcagggagtcccttccattagtgattttcttgcgtaacaggttgaagtacgccctgacaaactgtgaggtgaccaagatcgttatgcagagacttattaaggtcgacggcaaagtcaggactgatcctaactatcctgctggattcatggatgtgatcaccattgaaaaaactggtgaattcttccgtttgatctatgatgttaagggaagattcactattcacaggatcactgctgaagaagcaaaatacaaattgtgcaaagtccgcaaggtgcaaaccggaccaaaaggtattccattcttggtcacccacgatggtaggaccattaggtaccctgacccaatgatcaaggtaaacgacaccatccaactggaaatcgccacctcaaagatcctggactttatcaaattcgaatccggcaacttgtgcatgatcaccggaggcaggaatttgggtagagtgggaacggtagtgaacagggaaaggcatccgggatcattcgatattgtccacattagggacgctaatgatcacgtgttcgccactagattaaacaacgtattcgtcatcggtaaaggaagcaaagctttcgtgtctctgccaaggggcaagggagtgaaactgtccatcgctg

SEQ ID NO: 602 - protein, 242 aa, Anthonomus grandis
HLKRFAAPKAWMLDKLGGVFAPRPSTGPHKLRESLPLVIFLRNRLKYALTNCEVTKIVMQRLIKVDGKVRTDPNYPAGFMDVITIEKTGEFFRLIYDVKGRFTIHRITAEEAKYKLCKVRKVQTGPKGIPFLVTHDGRTIRYPDPMIKVNDTIQLEIATSKILDFIKFESGNLCMITGGRNLGRVGTVVNRERHPGSFDIVHIRDANDHVFATRLNNVFVIGKGSKAFVSLPRGKGVKLSIA

SEQ ID NO: 603 - DNA, 487 bp, Anthonomus grandis
ggtctggttggatccaaatgaaatcaatgagattgccaacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgagaaggcccgtgccaagatgttggccgaccaagctaacgccagaaggcaaaaggtgaaacaagtcccgtgagaggagggaagagcgtatcgccgcgaagaagcagga

SEQ ID NO: 604 - protein, 161 aa, Anthonomus grandis
VWLDPNEINEIANTNSRQNIRKLIKDGLIIKKPVAVHSRARVRKNTEARRKGRHCGFGKRKGTANARMPQKELWIQRMRVLRRLLKKYREAKKIDRHLYHALYMKAKGNVFKNKRVLMEYIHKKKAEKARAKMLADQANARRQKVKQVPEEGRAYRREEAG

SEQ ID NO: 605 - DNA, 904 bp, Anthonomus grandis
ctggcggccacatgcttatgggagactctttcaattcgtcgttgttcaaacaaactttccaaagggtgttcgcgaaggaccagaatggacatttgaagatggctttcaacggtactttggaggtgaagtgctctagggaattaaaagttcaaggcggtattggctcatgcgtgtcgctaaatgtaaaaagtcctttggtagcggacacggaaataggcatgggaaacaccgtgcaatggaagatgtgcaccttcaaccctagcacgacgatggcgctgtttttcgaggtggtcaatcagcattcggcccccattcctcaaggtggtagaggatgtatacagtttattacacaatatcagcactcgagtggccaaaggaggataagggtgacgacgatagcgagaaattgggcggacgcatcggcgaatattcaccacatcagcgcgggtttcgatcaggaacgtgccgcggtgattatggcccggatggctgtttatagagcggagaccgatgagagtcccgatgttttaagatgggtcgatcggatgctgattcgtttgtgtcaaaagtttggagaatataacaaagatgaccaggcatccttcagattaggagaaaattttagcttatacccgcaattcatgtaccacttaaggcgatcccagtttttgcaagtgttcaacaattcacctgacgaaacgtcgttttacaggcatatgcttatgagggaagatttgacacagtccctgataatgattcagccgatcttgtacagttacagttttaatggtcctccggagcccgttttgttggacaccagctcaatacaaccggacagaattctgcttatggacacgtttttccagatattgattttccatggagaaaccattgcccaatggcg

SEQ ID NO: 606 - protein, 300 aa, Anthonomus grandis
GGHMLMGDSFNSSLFKQTFQRVFAKDQNGHLKMAFNGTLEVKCSRELKVQGGIGSCVSLNVKSPLVADTEIGMGNTVQWKMCTFNPSTTMALFFEVVNQHSAPIPQGGRGCIQFITQYQHSSGQRRIRVTTIARNWADASANIHHISAGFDQERAAVIMARMAVYRAETDESPDVLRWVDRMLIRLCQKFGEYNKDDQASFRLGENFSLYPQFMYHLRRSQFLQVFNNSPDETSFYRHMLMREDLTQSLIMIQPILYSYSFNGPPEPVLLDTSSIQPDRILLMDTFFQILIFHGETIAQW

SEQ ID NO: 607 - DNA, 644 bp, Anthonomus grandis
cgcagatcaagcatatgatggccttcattgagcaagaggctaatgaaaaggccgaggaaattgatgccaaggcggaagaagaatttaacattgaaaagggccgccttgtgcaacaacaaagattgaagatcatggaatactatgagaagaaggagaagcaagtcgaactacaaaagaaaattcaatcctccaacatgctgaaccaagcccgtcttaaggttctgaaagtccgcgaagatcatgttagagctgtattggatgaggctcgcaagaagcttggtgaagtcaccagggatcaaggcaaatatgcccagattctggaatctttgatccttcagggactctaccagcttttcgaggcaaacgtgaccgtacgcgtccgcccacaagacagaaccttagtccaatcagtgctgccaaccatcgcaaccaaataccgtgacgtcaccggccgagatgtacacctgtccatcgatgacgaaactcaactgtccgaatccgtaaccggcggaatcgaacttttgtgcaaacaaaacaaaattaaggtctgcaacaccctggaggcacgtttggacctgatttcgcaacagttggttccgcaaatccgtaacgccttgttcggacgcaacatcaaccgcaagttc

SEQ ID NO: 608 - protein, 214 aa, Anthonomus grandis
QIKHMMAFIEQEANEKAEEIDAKAEEEFNIEKGRLVQQQRLKIMEYYEKKEKQVELQKKIQSSNMLNQARLKVLKVREDHVRAVLDEARKKLGEVTRDQGKYAQILESLILQGLYQLFEANVTVRVRPQDRTLVQSVLPTIATKYRDVTGRDVHLSIDDETQLSESVTGGIELLCKQNKIKVCNTLEARLDLISQQLVPQIRNALFGRNINRKF

SEQ ID NO: 609 - DNA, 734 bp, Anthonomus grandis
gtgtcggaggatatgttgggccgagtgttcaacggatcaggaaaacccattgacaaaggtcctccaatcttagccgaagatttcttggacatccaaggtcaacccatcaacccatggtcgcgtatctacccggaagaaatgatccagaccggtatctccgccatcgacgtgatgaactccatcgcgcgtgggcaaaaaatccccattttctccgcggccggtttaccgcacaacgaaatcgccgcccaaatctgtagacaggccggtttagtcaaactgccgggcaaatcggtaatcgacgatcacgaggacaatttcgccatcgtgttcgccgccatgggtgtcaacatggaaaccgcccgtttcttcaagcaggacttcgaagaaaacggttccatggagaacgtgtgtctcttcttgaatttggccaacgatcccaccatcgagagaatcatcacgccccgtttggctctgaccgccgccgaatttttggcttatcaatgcgagaaacacgtgctggttatcttaactgatatgtcttcttacgccgaggctttgcgtgaagtatccgccgccagagaagaagtacccggacgtcgtgggttccccggttacatgtacaccgatttggccaccatttacgaaagagccggtcgcgttgagggtagaaacggttccatcacccagattcccatcttgactatgccgaacgacgacatcacccatcctattcc

SEQ ID NO: 610 - protein, 244 aa, Anthonomus grandis
VSEDMLGRVFNGSGKPIDKGPPILAEDFLDIQGQPINPWSRIYPEEMIQTGISAIDVMNSIARGQKIPIFSAAGLPHNEIAAQICRQAGLVKLPGKSVIDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 611 - DNA, 23 bp, Artificial sequence
  Primer sequence
catttgaagcgtttwrmygcycc

SEQ ID NO: 612 - DNA, 23 bp, Artificial sequence
  Primer sequence
  misc_feature (18)..(18): n is a, c, g, or t
cgcttgtcccgctcctcngcrat

SEQ ID NO: 613 - DNA, 30 bp, Artificial sequence
  Primer sequence
ggtctggttggatcchaatgaaatcaayga

SEQ ID NO: 614 - DNA, 26 bp, Artificial sequence
  Primer sequence
tcctgcttcttsgyrgcratwcgytc

SEQ ID NO: 615 - DNA, 21 bp, Artificial sequence
  Primer sequence
ctggcggccacatgstbatgg

SEQ ID NO: 616 - DNA, 23 bp, Artificial sequence
  Primer sequence
cgccattgggcratggtytckcc

SEQ ID NO: 617 - DNA, 22 bp, Artificial sequence
  Primer sequence
cgcagatcaarcayatgatggc

SEQ ID NO: 618 - DNA, 24 bp, Artificial sequence
  Primer sequence
gaacttgcggttgabgttscgdcc

SEQ ID NO: 619 - DNA, 23 bp, Artificial sequence
  Primer sequence
gtgtcggaggatatgytgggycg

SEQ ID NO: 620 - DNA, 24 bp, Artificial sequence
  Primer sequence
ggaataggatgggtratrtcgtcg

SEQ ID NO: 621 - DNA, 26 bp, Anthonomus grandis
aaaactggtgaattcttccgtttgat

SEQ ID NO: 622 - DNA, 21 bp, Anthonomus grandis
aaagcatggatgttggacaaa

SEQ ID NO: 623 - DNA, 23 bp, Anthonomus grandis
aaagcatggatgttggacaaatt

SEQ ID NO: 624 - DNA, 26 bp, Anthonomus grandis
aaagcatggatgttggacaaattggg

SEQ ID NO: 625 - DNA, 32 bp, Anthonomus grandis; identical to SEQ ID NO: 279

SEQ ID NO: 626 - DNA, 23 bp, Anthonomus grandis
aaatacaaattgtgcaaagtccg

SEQ ID NO: 627 - DNA, 22 bp, Anthonomus grandis
aacttgtgcatgatcaccggag

SEQ ID NO: 628 - DNA, 27 bp, Anthonomus grandis
aagcatggatgttggacaaattggggg

SEQ ID NO: 629 - DNA, 34 bp, Anthonomus grandis
aagcatggatgttggacaaattggggggtgtgtt

SEQ ID NO: 630 - DNA, 23 bp, Anthonomus grandis
actggtgaattcttccgtttgat

SEQ ID NO: 631 - DNA, 44 bp, Anthonomus grandis
attgaaaaaactggtgaattcttccgtttgatctatgatgttaa

SEQ ID NO: 632 - DNA, 22 bp, Anthonomus grandis
ccaaagcatggatgttggacaa

SEQ ID NO: 633 - DNA, 23 bp, Anthonomus grandis
cccaaagcatggatgttggacaa

SEQ ID NO: 634 - DNA, 24 bp, Anthonomus grandis
cccaaagcatggatgttggacaaa

SEQ ID NO: 635 - DNA, 26 bp, Anthonomus grandis
cccaaagcatggatgttggacaaatt

SEQ ID NO: 636 - DNA, 29 bp, Anthonomus grandis
cccaaagcatggatgttggacaaattggg

SEQ ID NO: 637 - DNA, 31 bp, Anthonomus grandis
cccaaagcatggatgttggacaaattggggg

SEQ ID NO: 638 - DNA, 35 bp, Anthonomus grandis; identical to SEQ ID NO: 291

SEQ ID NO: 639 - DNA, 38 bp, Anthonomus grandis
cccaaagcatggatgttggacaaattggggggtgtgtt

SEQ ID NO: 640 - DNA, 21 bp, Anthonomus grandis
ctggattcatggatgtgatca

SEQ ID NO: 641 - DNA, 26 bp, Anthonomus grandis
gaattcttccgtttgatctatgatgt

SEQ ID NO: 642 - DNA, 23 bp, Anthonomus grandis
gcatggatgttggacaaattggg

SEQ ID NO: 643 - DNA, 25 bp, Anthonomus grandis
gcatggatgttggacaaattggggg

SEQ ID NO: 644 - DNA, 29 bp, Anthonomus grandis
gcatggatgttggacaaattggggggtgt

SEQ ID NO: 645 - DNA, 38 bp, Anthonomus grandis
gcatggatgttggacaaattggggggtgtgttcgcccc

SEQ ID NO: 646 - DNA, 26 bp, Anthonomus grandis
gcccccaaagcatggatgttggacaa

SEQ ID NO: 647 - DNA, 21 bp, Anthonomus grandis
gctggattcatggatgtgatc

SEQ ID NO: 648 - DNA, 23 bp, Anthonomus grandis
ggatcattcgatattgtccacat

SEQ ID NO: 649 - DNA, 26 bp, Anthonomus grandis
ggcaacttgtgcatgatcaccggagg

SEQ ID NO: 650 - DNA, 23 bp, Anthonomus grandis
tacaaattgtgcaaagtccgcaa

SEQ ID NO: 651 - DNA, 23 bp, Anthonomus grandis
tatcctgctggattcatggatgt

SEQ ID NO: 652 - DNA, 29 bp, Anthonomus grandis
tcaccattgaaaaaactggtgaattcttc

SEQ ID NO: 653 - DNA, 23 bp, Anthonomus grandis
tgcatgatcaccggaggcaggaa

SEQ ID NO: 654 - DNA, 29 bp, Anthonomus grandis
tgcatgatcaccggaggcaggaatttggg

SEQ ID NO: 655 - DNA, 26 bp, Anthonomus grandis
tggatgttggacaaattggggggtgt

SEQ ID NO: 656 - DNA, 22 bp, Anthonomus grandis
tgtgcatgatcaccggaggcag

SEQ ID NO: 657 - DNA, 31 bp, Anthonomus grandis
tgtgcatgatcaccggaggcaggaatttggg

SEQ ID NO: 658 - DNA, 25 bp, Anthonomus grandis
aagatcgacaggcatctgtaccacg

SEQ ID NO: 659 - DNA, 41 bp, Anthonomus grandis
aagatcgacaggcatctgtaccacgccctgtacatgaaggc

SEQ ID NO: 660 - DNA, 23 bp, Anthonomus grandis
aagggtaacgtgttcaagaacaa

SEQ ID NO: 661 - DNA, 24 bp, Anthonomus grandis
aagggtaacgtgttcaagaacaag

SEQ ID NO: 662 - DNA, 29 bp, Anthonomus grandis
aagggtaacgtgttcaagaacaagagagt

SEQ ID NO: 663 - DNA, 22 bp, Anthonomus grandis
acaagaagaaggctgagaaggc

SEQ ID NO: 664 - DNA, 23 bp, Anthonomus grandis
atcaaggatggtttgatcattaa

SEQ ID NO: 665 - DNA, 24 bp, Anthonomus grandis
atggaatacatccacaagaagaag

SEQ ID NO: 666 - DNA, 30 bp, Anthonomus grandis
caaaacatccgtaaattgatcaaggatggt

SEQ ID NO: 667 - DNA, 38 bp, Anthonomus grandis
caaaacatccgtaaattgatcaaggatggtttgatcat

SEQ ID NO: 668 - DNA, 21 bp, Anthonomus grandis
caagggtaacgtgttcaagaa

SEQ ID NO: 669 - DNA, 25 bp, Anthonomus grandis
caagggtaacgtgttcaagaacaag

SEQ ID NO: 670 - DNA, 29 bp, Anthonomus grandis
catctgtaccacgccctgtacatgaaggc

SEQ ID NO: 671 - DNA, 21 bp, Anthonomus grandis
gaagaaggctgagaaggcccg

SEQ ID NO: 672 - DNA, 35 bp, Anthonomus grandis
gacaggcatctgtaccacgccctgtacatgaaggc

SEQ ID NO: 673 - DNA, 24 bp, Anthonomus grandis
gagaaggcccgtgccaagatgttg

SEQ ID NO: 674 - DNA, 26 bp, Anthonomus grandis
gatccaaatgaaatcaatgagattgc

SEQ ID NO: 675 - DNA, 27 bp, Anthonomus grandis
gctcgtatgcctcaaaaggaactatgg

SEQ ID NO: 676 - DNA, 22 bp, Anthonomus grandis
gggtaacgtgttcaagaacaag

SEQ ID NO: 677 - DNA, 21 bp, Anthonomus grandis
ggtaacgtgttcaagaacaag

SEQ ID NO: 678 - DNA, 27 bp, Anthonomus grandis
tacatccacaagaagaaggctgagaag

SEQ ID NO: 679 - DNA, 23 bp, Anthonomus grandis
taccacgccctgtacatgaaggc

SEQ ID NO: 680 - DNA, 25 bp, Anthonomus grandis
tcaatgagattgccaacaccaactc

SEQ ID NO: 681 - DNA, 22 bp, Anthonomus grandis
tgatcaaggatggtttgatcat

SEQ ID NO: 682 - DNA, 28 bp, Anthonomus grandis
tgatcaaggatggtttgatcattaagaa

SEQ ID NO: 683 - DNA, 22 bp, Anthonomus grandis
tggttggatccaaatgaaatca

SEQ ID NO: 684 - DNA, 23 bp, Anthonomus grandis
tggttggatccaaatgaaatcaa

SEQ ID NO: 685 - DNA, 29 bp, Anthonomus grandis
tggttggatccaaatgaaatcaatgagat

SEQ ID NO: 686 - DNA, 25 bp, Anthonomus grandis
tgtaccacgccctgtacatgaaggc

SEQ ID NO: 687 - DNA, 22 bp, Anthonomus grandis
ttgatcaaggatggtttgatca

SEQ ID NO: 688 - DNA, 23 bp, Anthonomus grandis
ttgatcaaggatggtttgatcat

SEQ ID NO: 689 - DNA, 29 bp, Anthonomus grandis
ttgatggaatacatccacaagaagaaggc

SEQ ID NO: 690 - DNA, 23 bp, Anthonomus grandis
aggatgcgtgtcttgaggcgtct

SEQ ID NO: 691 - DNA, 30 bp, Anthonomus grandis
aaggccaagggtaacgtgttcaagaacaag

SEQ ID NO: 692 - DNA, 26 bp, Anthonomus grandis
cgtttgtgtcaaaagtttggagaata

SEQ ID NO: 693 - DNA, 23 bp, Anthonomus grandis
gatgttttaagatgggtcgatcg

SEQ ID NO: 694 - DNA, 32 bp, Anthonomus grandis
ttttacaggcatatgcttatgagggaagattt

SEQ ID NO: 695 - DNA, 29 bp, Anthonomus grandis
tttttcgaggtggtcaatcagcattcggc

SEQ ID NO: 696 - DNA, 21 bp, Anthonomus grandis
aacatgctgaaccaagcccgt

SEQ ID NO: 697 - DNA, 23 bp, Anthonomus grandis
aacatgctgaaccaagcccgtct

SEQ ID NO: 698 - DNA, 26 bp, Anthonomus grandis
aagatcatggaatactatgagaagaa

SEQ ID NO: 699 - DNA, 32 bp, Anthonomus grandis
aagatcatggaatactatgagaagaaggagaa

SEQ ID NO: 700 - DNA, 26 bp, Anthonomus grandis
aatgaaaaggccgaggaaattgatgc

SEQ ID NO: 701 - DNA, 23 bp, Anthonomus grandis
atggaatactatgagaagaagga

SEQ ID NO: 702 - DNA, 23 bp, Anthonomus grandis
caatcctccaacatgctgaacca

SEQ ID NO: 703 - DNA, 26 bp, Anthonomus grandis
cagatcaagcatatgatggccttcat

SEQ ID NO: 704 - DNA, 27 bp, Anthonomus grandis
gcagatcaagcatatgatggccttcat

SEQ ID NO: 705 - DNA, 29 bp, Anthonomus grandis
gcggaagaagaatttaacattgaaaaggg

SEQ ID NO: 706 - DNA, 25 bp, Anthonomus grandis
aacgacgacatcacccatcctattc

SEQ ID NO: 707 - DNA, 23 bp, Anthonomus grandis
aacggttccatggagaacgtgtg

SEQ ID NO: 708 - DNA, 26 bp, Anthonomus grandis
aacggttccatggagaacgtgtgtct

SEQ ID NO: 709 - DNA, 35 bp, Anthonomus grandis
aacggttccatggagaacgtgtgtctcttcttgaa

SEQ ID NO: 710 - DNA, 23 bp, Anthonomus grandis
atgatccagaccggtatctccgc

SEQ ID NO: 711 - DNA, 26 bp, Anthonomus grandis
atgccgaacgacgacatcacccatcc

SEQ ID NO: 712 - DNA, 23 bp, Anthonomus grandis
caatgcgagaaacacgtgctggt

SEQ ID NO: 713 - DNA, 26 bp, Anthonomus grandis
ccgcacaacgaaatcgccgcccaaat

SEQ ID NO: 714 - DNA, 23 bp, Anthonomus grandis
cgtttcttcaagcaggacttcga

SEQ ID NO: 715 - DNA, 36 bp, Anthonomus grandis
cttggacatccaaggtcaacccatcaacccatggtc

SEQ ID NO: 716 - DNA, 23 bp, Anthonomus grandis
gaaatgatccagaccggtatctc

SEQ ID NO: 717 - DNA, 44 bp, Anthonomus grandis
gaaatgatccagaccggtatctccgccatcgacgtgatgaactc

SEQ ID NO: 718 - DNA, 23 bp, Anthonomus grandis
gaagaaatgatccagaccggtat

SEQ ID NO: 719 - DNA, 23 bp, Anthonomus grandis
gaagaagtacccggacgtcgtgg

SEQ ID NO: 720 - DNA, 23 bp, Anthonomus grandis
gacatccaaggtcaacccatcaa

SEQ ID NO: 721 - DNA, 26 bp, Anthonomus grandis
gcccgtttcttcaagcaggacttcga

SEQ ID NO: 722 - DNA, 23 bp, Anthonomus grandis
gccgcccaaatctgtagacaggc

SEQ ID NO: 723 - DNA, 29 bp, Anthonomus grandis
ggatcaggaaaacccattgacaaaggtcc

SEQ ID NO: 724 - DNA, 23 bp, Anthonomus grandis
ggttacatgtacaccgatttggc

SEQ ID NO: 725 - DNA, 29 bp, Anthonomus grandis
ggttacatgtacaccgatttggccaccat

SEQ ID NO: 726 - DNA, 36 bp, Anthonomus grandis
ggttacatgtacaccgatttggccaccatttacgaa

SEQ ID NO: 727 - DNA, 23 bp, Anthonomus grandis
gtgtcggaggatatgttgggccg

SEQ ID NO: 728 - DNA, 26 bp, Anthonomus grandis
tacatgtacaccgatttggccaccat

SEQ ID NO: 729 - DNA, 35 bp, Anthonomus grandis
ttcaacggatcaggaaaacccattgacaaaggtcc

SEQ ID NO: 730 - DNA, 32 bp, Anthonomus grandis
ttccccggttacatgtacaccgatttggccac

SEQ ID NO: 731 - DNA, 35 bp, Anthonomus grandis
ttccccggttacatgtacaccgatttggccaccat

SEQ ID NO: 732 - DNA, 38 bp, Anthonomus grandis
ttccccggttacatgtacaccgatttggccaccattta

SEQ ID NO: 733 - DNA, 41 bp, Anthonomus grandis
ttccccggttacatgtacaccgatttggccaccatttacga

SEQ ID NO: 734 - DNA, 29 bp, Anthonomus grandis
ttcgccatcgtgttcgccgccatgggtgt

SEQ ID NO: 735 - DNA, 23 bp, Anthonomus grandis
ttcttcaagcaggacttcgaaga

SEQ ID NO: 736 - DNA, 23 bp, Anthonomus grandis
ttcttgaatttggccaacgatcc

SEQ ID NO: 737 - DNA, 33 bp, Anthonomus grandis
ttcttgaatttggccaacgatcccaccatcgag

SEQ ID NO: 738 - DNA, 23 bp, Anthonomus grandis
gccgaatttttggcttatcaatg

SEQ ID NO: 739 - DNA, 22 bp, Anthonomus grandis
gctggattcatggatgtgatca

SEQ ID NO: 740 - DNA, 21 bp, Anthonomus grandis
atggatgttggacaaattggg

SEQ ID NO: 741 - DNA, 23 bp, Anthonomus grandis
ttcatggatgtgatcaccattga

SEQ ID NO: 742 - DNA, 29 bp, Anthonomus grandis
gtctggttggatccaaatgaaatcaatga

SEQ ID NO: 743 - DNA, 21 bp, Anthonomus grandis
ggatccaaatgaaatcaatga

SEQ ID NO: 744 - DNA, 22 bp, Anthonomus grandis
tgatcaaggatggtttgatcat

SEQ ID NO: 745 - DNA, 26 bp, Anthonomus grandis
tggttggatccaaatgaaatcaatga

SEQ ID NO: 746 - DNA, 26 bp, Anthonomus grandis
ccaagggtaacgtgttcaagaacaag

SEQ ID NO: 747 - DNA, 26 bp, Anthonomus grandis
tggttggatccaaatgaaatcaatga

SEQ ID NO: 748 - DNA, 22 bp, Anthonomus grandis
tggatccaaatgaaatcaatga

SEQ ID NO: 749 - DNA, 23 bp, Anthonomus grandis
gaagaatttaacattgaaaaggg

SEQ ID NO: 750 - DNA, 23 bp, Anthonomus grandis
gaatttaacattgaaaagggccg

SEQ ID NO: 751 - DNA, 23 bp, Anthonomus grandis
ggttacatgtacaccgatttggc

SEQ ID NO: 752 - DNA, 23 bp, Anthonomus grandis
cgtaacaggttgaagtacgccct

SEQ ID NO: 753 - DNA, 27 bp, Anthonomus grandis
aaggtcgacggcaaagtcaggactgat

SEQ ID NO: 754 - DNA, 22 bp, Anthonomus grandis
ccattcttggtcacccacgatg

SEQ ID NO: 755 - DNA, 21 bp, Anthonomus grandis
atcaaggtaaacgacaccatc

SEQ ID NO: 756 - DNA, 38 bp, Anthonomus grandis
tgtacatgaaggccaagggtaacgtgttcaagaacaag

SEQ ID NO: 757 - DNA, 26 bp, Anthonomus grandis
ccaagggtaacgtgttcaagaacaag

SEQ ID NO: 758 - DNA, 24 bp, Anthonomus grandis
aagggtaacgtgttcaagaacaag

SEQ ID NO: 759 - DNA, 21 bp, Anthonomus grandis
caagaagaaggctgagaaggc

SEQ ID NO: 760 - DNA, 21 bp, Anthonomus grandis
caagaagaaggctgagaaggc

SEQ ID NO: 761 - DNA, 21 bp, Anthonomus grandis
aagaagaaggctgagaaggcc

SEQ ID NO: 762 - DNA, 32 bp, Anthonomus grandis
caaaacatccgtaaattgatcaaggatggttt

SEQ ID NO: 763 - DNA, 21 bp, Anthonomus grandis
ttcgccgccatgggtgtcaac

SEQ ID NO: 764 - DNA, 23 bp, Anthonomus grandis
atgggtgtcaacatggaaaccgc

SEQ ID NO: 765 - DNA, 21 bp, Anthonomus grandis
tggaaaccgcccgtttcttca

SEQ ID NO: 766 - DNA, 21 bp, Anthonomus grandis
ggttacatgtacaccgatttg

SEQ ID NO: 767 - DNA, 26 bp, Anthonomus grandis
gtcaagatgggaatctgggtgatgga

SEQ ID NO: 768 - DNA, 444 bp, Anthonomus grandis
gcatggatgttggacaaattggggggtgtgttcgcccccaggccctccaccgggccacacaagctcagggagtcccttccattagtgattttcttgcgtaacaggttgaagtacgccctgacaaactgtgaggtgaccaagatcgttatgcagagacttattaaggtcgacggcaaagtcaggactgatcctaactatcctgctggattcatggatgtgatcaccattgaaaaaactggtgaattcttccgtttgatctatgatgttaagggaagattcactattcacaggatcactgctgaagaagcaaaatacaaattgtgcaaagtccgcaaggtgcaaaccggaccaaaaggtattccattcttggtcacccacgatggtaggaccattaggtaccctgacccaatgatcaaggtaaacgacaccatccaactggaaatc

SEQ ID NO: 769 - DNA, 44 bp, Artificial sequence
  Primer sequence
gcgtaatacgactcactatagggcatggatgttggacaaattgg

SEQ ID NO: 770 - DNA, 22 bp, Artificial sequence
  Primer sequence
gatttccagttggatggtgtcg

SEQ ID NO: 771 - DNA, 22 bp, Artificial sequence
  Primer sequence
gcatggatgttggacaaattgg

SEQ ID NO: 772 - DNA, 44 bp, Artificial sequence
  Primer sequence
gcgtaatacgactcactatagggatttccagttggatggtgtcg

SEQ ID NO: 773 - DNA, 398 bp, Anthonomus grandis
caacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgagaaggcccgtgccaagatgttggccgaccaagctaacgccagaaggcaaaagg

SEQ ID NO: 774 - DNA, 44 bp, Artificial sequence
  Primer sequence
gcgtaatacgactcactataggcaacaccaactcgaggcaaaac

SEQ ID NO: 775 - DNA, 21 bp, Artificial sequence
  Primer sequence
ccttttgccttctggcgttag

SEQ ID NO: 776 - DNA, 22 bp, Artificial sequence
  Primer sequence
caacaccaactcgaggcaaaac

SEQ ID NO: 777 - DNA, 43 bp, Artificial sequence
  Primer sequence
gcgtaatacgactcactataggccttttgccttctggcgttag

SEQ ID NO: 778 - DNA, 555 bp, Anthonomus grandis
caaactttccaaagggtgttcgcgaaggaccagaatggacatttgaagatggctttcaacggtactttggaggtgaagtgctctagggaattaaaagttcaaggcggtattggctcatgcgtgtcgctaaatgtaaaaagtcctttggtagcggacacggaaataggcatgggaaacaccgtgcaatggaagatgtgcaccttcaaccctagcacgacgatggcgctgtttttcgaggtggtcaatcagcattcggcccccattcctcaaggtggtagaggatgtatacagtttattacacaatatcagcactcgagtggccaaaggaggataagggtgacgacgatagcgagaaattgggcggacgcatcggcgaatattcaccacatcagcgcgggtttcgatcaggaacgtgccgcggtgattatggcccggatggctgtttatagagcggagaccgatgagagtcccgatgttttaagatgggtcgatcggatgctgattcgtttgtgtcaaaagtttggagaatataacaaagatgaccaggcatccttc

SEQ ID NO: 779 - DNA, 44 bp, Artificial sequence
  Primer sequence
gcgtaatacgactcactataggcaaactttccaaagggtgttcg

SEQ ID NO: 780 - DNA, 22 bp, Artificial sequence
  Primer sequence
gaaggatgcctggtcatctttg

SEQ ID NO: 781 - DNA, 22 bp, Artificial sequence
  Primer sequence
caaactttccaaagggtgttcg

SEQ ID NO: 782 - DNA, 44 bp, Artificial sequence
  Primer sequence
gcgtaatacgactcactatagggaaggatgcctggtcatctttg

SEQ ID NO: 783 - DNA, 549 bp, Anthonomus grandis
gaaaaggccgaggaaattgatgccaaggcggaagaagaatttaacattgaaaagggccgccttgtgcaacaacaaagattgaagatcatggaatactatgagaagaaggagaagcaagtcgaactacaaaagaaaattcaatcctccaacatgctgaaccaagcccgtcttaaggttctgaaagtccgcgaagatcatgttagagctgtattggatgaggctcgcaagaagcttggtgaagtcaccagggatcaaggcaaatatgcccagattctggaatctttgatccttcagggactctaccagcttttcgaggcaaacgtgaccgtacgcgtccgcccacaagacagaaccttagtccaatcagtgctgccaaccatcgcaaccaaataccgtgacgtcaccggccgagatgtacacctgtccatcgatgacgaaactcaactgtccgaatccgtaaccggcggaatcgaacttttgtgcaaacaaaacaaaattaaggtctgcaacaccctggaggcacgtttggacctgatttcgcaacagttg

SEQ ID NO: 784 - DNA, 44 bp, Artificial sequence
  Primer sequence
gcgtaatacgactcactatagggaaaaggccgaggaaattgatg

SEQ ID NO: 785 - DNA, 22 bp, Artificial sequence
  Primer sequence
caactgttgcgaaatcaggtcc

SEQ ID NO: 786 - DNA, 22 bp, Artificial sequence
  Primer sequence
gaaaaggccgaggaaattgatg

SEQ ID NO: 787 - DNA, 44 bp, Artificial sequence
  Primer sequence
gcgtaatacgactcactataggcaactgttgcgaaatcaggtcc

SEQ ID NO: 788 - DNA, 632 bp, Anthonomus grandis
gtgttcaacggatcaggaaaacccattgacaaaggtcctccaatcttagccgaagatttcttggacatccaaggtcaacccatcaacccatggtcgcgtatctacccggaagaaatgatccagaccggtatctccgccatcgacgtgatgaactccatcgcgcgtgggcaaaaaatccccattttctccgcggccggtttaccgcacaacgaaatcgccgcccaaatctgtagacaggccggtttagtcaaactgccgggcaaatcggtaatcgacgatcacgaggacaatttcgccatcgtgttcgccgccatgggtgtcaacatggaaaccgcccgtttcttcaagcaggacttcgaagaaaacggttccatggagaacgtgtgtctcttcttgaatttggccaacgatcccaccatcgagagaatcatcacgccccgtttggctctgaccgccgccgaatttttggcttatcaatgcgagaaacacgtgctggttatcttaactgatatgtcttcttacgccgaggctttgcgtgaagtatccgccgccagagaagaagtacccggacgtcgtgggttccccggttacatgtacaccgatttggccaccatttacgaaagagccggtcg

SEQ ID NO: 789 - DNA, 45 bp, Artificial sequence
  Primer sequence
gcgtaatacgactcactatagggtgttcaacggatcaggaaaacc

SEQ ID NO: 790 - DNA, 21 bp, Artificial sequence
  Primer sequence
cgaccggctctttcgtaaatg

SEQ ID NO: 791 - DNA, 23 bp, Artificial sequence
  Primer sequence
gtgttcaacggatcaggaaaacc

SEQ ID NO: 792 - DNA, 43 bp, Artificial sequence
  Primer sequence
gcgtaatacgactcactataggcgaccggctctttcgtaaatg

SEQ ID NO: 793 - DNA, 642 bp, Tribolium castaneum
ggccccaagaagcatttgaagcgtctcaatgcgcccaaagcatggatgttggataaactggggggtgtgtttgcccctcggccttccaccggcccccacaagctacgggagtcgctacctttggttatcttcctgcgaaacaggctgaagtatgccttgaccaactcagaagtgacgaagattgttatgcaaagattgattaaagttgacggaaaagttaggacagaccccaactaccccgcgggtttcatggatgttgtgactattgagaaaactggggaattcttccgcttgatttatgatgttaagggaaggttcacaatccatcgcattactggagaagaggccaaatataaattgtgcaaagtgaagaaagtacagacaggccccaagggcattcccttcttggtgacccgcgacggacgcactatcagatacccagaccccatgatcaaagtgaatgacaccattcaattggagattgccacttcgaaaattcttgattttatcaaatttgagtccggtaatttgtgtatgattactggaggtcgtaacttggggcgtgtcggtacagtggtgagccgagaacgtcacccaggttccttcgacatcgttcatattaaggatgcaaatgggcacacc

SEQ ID NO: 794 - protein, 245 aa, Tribolium castaneum
GPKKHLKRLNAPKAWMLDKLGGVFAPRPSTGPHKLRESLPLVIFLRNRLKYALTNSEVTKIVMQRLIKVDGKVRTDPNYPAGFMDVVTIEKTGEFFRLIYDVKGRFTIHRITGEEAKYKLCKVKKVQTGPKGIPFLVTRDGRTIRYPDPMIKVNDTIQLEIATSKILDFIKFESGNLCMITGGRNLGRVGTVVSRERHPGSFDIVHIKDANGHTFATRLNNVFIIGKGSKPYVSLPRGKGVKLSI

SEQ ID NO: 795 - DNA, 290 bp, Tribolium castaneum
caggagttcctggaggctaaaatcgaccaagagatcctcacagcgaagaaaaacgcgtcgaaaaacaaacgagcggccatccaggccatcaagaggaagaaacgctacgaaaagcagctccagcagatcgatggcaccctcagcaccatcgagatgcagcgggaggccctcgagggggccaacaccaacacagccgtactcaaaacgatgaaaaacgcagcggacgccctcaaaaatgcccacctcaacatggatgttgatgaggtacatgacatgatggatgacattgc

SEQ ID NO: 796 - protein, 96 aa, Tribolium castaneum
QEFLEAKIDQEILTAKKNASKNKRAAIQAIKRKKRYEKQLQQIDGTLSTIEMQREALEGANTNTAVLKTMKNAADALKNAHLNMDVDEVHDMMDDI

SEQ ID NO: 797 - DNA, 384 bp, Tribolium castaneum
aaaattcggcgaatacaacaaagacgaccctaacagtttccgtttgagtgaaaacttcagtctctatccccaattcatgtaccatttgcgccgctcccaattcctccaagttttcaacaactccccagacgagacctcgttctaccgccacatgctgatgcgggaggacctcacccaaagtctcattatgatccagccgattttgtacagttatagtttcaacggcccccctgaacccgtcctcctcgacactagttccattcaacccgatcggatccttctcatggacacatttttccaaattttgattttccacggtgagacaatcgcccaatggaggaacctcaagtaccaggacatgcccgaatacgagaacttccggca

SEQ ID NO: 798 - protein, 127 aa, Tribolium castaneum
PEVLVFGHVLVLEVPPLGDCLTVENQNLEKCVHEKDPIGLNGTSVEEDGFRGAVETITVQNRLDHNETLGEVLPHQHVAVERGLVWGVVENLEELGAAQMVHELGIETEVFTQTETVRVVFVVFAEF

SEQ ID NO: 799 - DNA, 621 bp, Tribolium castaneum
gagaaagccgaagaaatcgatgcgaaagctgaggaggagtttaacattgaaaaagggcgcctggtccaacaacagcgcttgaagatcatggaatattacgagaagaaggagaaaccggtggaattgcagaagaaaattcagtcgtcaaacatgctgaaccaagcccgtttgaaagtattaaaagtgcgtgaagaccacgtccacaatgtgctggatgacgcccgcaaacgtctgggcgaaatcaccaatgaccaggcgagatattcacaacttttggagtctcttatcctccagagtctctaccagtacttgggaatcagtgatgagttgtttgagaacaatatagtggtgagagtcaggcaacaggacaggagtataatccagggcattctcccagttgttgcgacgaaatacagggacgccactggtaaagacgttcatcttaaaatcgacgatgagagccacttgccatccgaaaccaccggaggagtggttttgtatgcgcaaaagggtaaaatcaagattgacaacaccttggaggctcgtttggatttaattgcacagcaacttgtgccagaaattcgtacggccttgtttggacgcaacatcaaccgcaagttc

SEQ ID NO: 800 - protein, 207 aa, Tribolium castaneum
EKAEEIDAKAEEEFNIEKGRLVQQQRLKIMEYYEKKEKPVELQKKIQSSNMLNQARLKVLKVREDHVHNVLDDARKRLGEITNDQARYSQLLESLILQSLYQYLGISDELFENNIVVRVRQQDRSIIQGILPVVATKYRDATGKDVHLKIDDESHLPSETTGGVVLYAQKGKIKIDNTLEARLDLIAQQLVPEIRTALFGRNINRKF

SEQ ID NO: 801 - DNA, 957 bp, Tribolium castaneum
ggatgaactacagctgttccgtggcgatacagtgttgctgaaagggaagcggcggaaagagaccgtctgcattgtgctggccgacgaaaactgccccgatgagaagatccggatgaacaggatcgtcaggaataatctacgggttaggctctctgacgtcgtctggatccagccctgtcccgacgtcaaatacgggaagaggatccacgttttgcccatcgatgacacggtcgaagggctcgtcggaaatctcttcgaggtgtacttaaaaccatacttcctcgaagcttatcgaccaatccacaaaggcgacgttttcatcgtccgtggtggcatgcgagccgttgaattcaaagtggtggaaacggaaccgtcaccatattgtatcgtcgcccccgataccgtcatccattgtgacggcgatccgatcaaacgagaagaagaggaggaagccttgaacgccgtcggctacgacgatatcggcggttgtcgcaaacaactcgcacaaatcaaagaaatggtcgaattacctctacgccacccgtcgctcttcaaggccattggcgtgaaaccaccacgtggtatcctcttgtacggacctccaggtaccggtaaaactttaatcgcacgtgcagtggccaacgaaaccggtgctttcttcttcttaatcaacggtcccgaaattatgagtaaattagccggcgaatccgaaagtaatctaaggaaagcgttcgaagaagccgataaaaactcaccggctattattttcatcgatgaattggacgcgattgcaccgaaacgtgaaaaaacccacggcgaagtcgaacgccgaattgtctcgcaattgttaacactgatggacggcatgaagaaaagctcgcatgttatcgtgatggcggccacaaatcgcccgaactcaatcgatccggctttgcgtcggttcggtcgctttgatcg

SEQ ID NO: 802 - protein, 318 aa, Tribolium castaneum
DELQLFRGDTVLLKGKRRKETVCIVLADENCPDEKIRMNRIVRNNLRVRLSDVVWIQPCPDVKYGKRIHVLPIDDTVEGLVGNLFEVYLKPYFLEAYRPIHKGDVFIVRGGMRAVEFKVVETEPSPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFD

SEQ ID NO: 803 - DNA, 23 bp, Artificial sequence
  Primer sequence
ggccccaagaagcatttgaagcg

SEQ ID NO: 804 - DNA, 23 bp, Artificial sequence
  Primer sequence
  misc_feature (18)..(18): n is a, c, g, or t
cgcttgtcccgctcctcngcrat

SEQ ID NO: 805 - DNA, 23 bp, Artificial sequence
  Primer sequence
  misc_feature (18)..(18): n is a, c, g, or t
cgcttgtcccgctcctcngcrat

SEQ ID NO: 806 - DNA, 26 bp, Artificial sequence
  Primer sequence
gcaatgtcatccatcakrtcrtgtac

SEQ ID NO: 807 - DNA, 22 bp, Artificial sequence
  Primer sequence
gcattctgcgctgggtcgatcg

SEQ ID NO: 808 - DNA, 22 bp, Artificial sequence
  Primer sequence
gcattctgcgctgggtcgatcg

SEQ ID NO: 809 - DNA, 23 bp, Artificial sequence
  Primer sequence
gagaaagccgargaratygatgc

SEQ ID NO: 810 - DNA, 24 bp, Artificial sequence
  Primer sequence
gaacttgcggttgabgttscgdcc

SEQ ID NO: 811 - DNA, 24 bp, Artificial sequence
  Primer sequence
ggatgaactacagctbttccghgg

SEQ ID NO: 812 - DNA, 23 bp, Artificial sequence
  Primer sequence
cgatcaaagcgwccraavcgacg

SEQ ID NO: 813 - DNA, 21 bp, Tribolium castaneum
aaagcatggatgttggataaa

SEQ ID NO: 814 - DNA, 23 bp, Tribolium castaneum
aatttgtgtatgattactggagg

SEQ ID NO: 815 - DNA, 26 bp, Tribolium castaneum
actggaggtcgtaacttggggcgtgt

SEQ ID NO: 816 - DNA, 32 bp, Tribolium castaneum
atgattactggaggtcgtaacttggggcgtgt

SEQ ID NO: 817 - DNA, 26 bp, Tribolium castaneum
atgcaaagattgattaaagttgacgg

SEQ ID NO: 818 - DNA, 21 bp, Tribolium castaneum
attaaagttgacggaaaagtt

SEQ ID NO: 819 - DNA, 26 bp, Tribolium castaneum
attgagaaaactggggaattcttccg

SEQ ID NO: 820 - DNA, 38 bp, Tribolium castaneum
attgttatgcaaagattgattaaagttgacggaaaagt

SEQ ID NO: 821 - DNA, 22 bp, Tribolium castaneum
ccaagaagcatttgaagcgtct

SEQ ID NO: 822 - DNA, 23 bp, Tribolium castaneum
ccaagaagcatttgaagcgtctc

SEQ ID NO: 823 - DNA, 23 bp, Tribolium castaneum
gcgcccaaagcatggatgttgga

SEQ ID NO: 824 - DNA, 24 bp, Tribolium castaneum
ggccccaagaagcatttgaagcgt

SEQ ID NO: 825 - DNA, 31 bp, Tribolium castaneum
tgattactggaggtcgtaacttggggcgtgt

SEQ ID NO: 826 - DNA, 35 bp, Tribolium castaneum
tgtatgattactggaggtcgtaacttggggcgtgt

SEQ ID NO: 827 - DNA, 21 bp, Tribolium castaneum
ttgatttatgatgttaaggga

SEQ ID NO: 828 - DNA, 26 bp, Tribolium castaneum
ttgtgtatgattactggaggtcgtaa

SEQ ID NO: 829 - DNA, 26 bp, Tribolium castaneum
aaaaacaaacgagcggccatccaggc

SEQ ID NO: 830 - DNA, 66 bp, Tribolium castaneum
atcgaccaagagatcctcacagcgaagaaaaacgcgtcgaaaaacaaacgagcggccatccaggcc

SEQ ID NO: 831 - DNA, 23 bp, Tribolium castaneum
ctccagcagatcgatggcaccct

SEQ ID NO: 832 - DNA, 178 bp, Tribolium castaneum
tcaagaggaagaaacgctacgaaaagcagctccagcagatcgatggcaccctcagcaccatcgagatgcagcgggaggccctcgagggggccaacaccaacacagccgtactcaaaacgatgaaaaacgcagcggacgccctcaaaaatgcccacctcaacatggatgttgatgaggt

SEQ ID NO: 833 - DNA, 26 bp, Tribolium castaneum
aacctcaagtaccaggacatgcccga

SEQ ID NO: 834 - DNA, 21 bp, Tribolium castaneum
agccgattttgtacagttata

SEQ ID NO: 835 - DNA, 21 bp, Tribolium castaneum
atggacacatttttccaaatt

SEQ ID NO: 836 - DNA, 35 bp, Tribolium castaneum
atggacacatttttccaaattttgattttccacgg

SEQ ID NO: 837 - DNA, 21 bp, Tribolium castaneum
caagtaccaggacatgcccga

SEQ ID NO: 838 - DNA, 24 bp, Tribolium castaneum
cacatgctgatgcgggaggacctc

SEQ ID NO: 839 - DNA, 24 bp, Tribolium castaneum
cctcaagtaccaggacatgcccga

SEQ ID NO: 840 - DNA, 22 bp, Tribolium castaneum
tcaagtaccaggacatgcccga

SEQ ID NO: 841 - DNA, 23 bp, Tribolium castaneum
ttcatgtaccatttgcgccgctc

SEQ ID NO: 842 - DNA, 26 bp, Tribolium castaneum
aaaattcagtcgtcaaacatgctgaa

SEQ ID NO: 843 - DNA, 21 bp, Tribolium castaneum
aacatgctgaaccaagcccgt

SEQ ID NO: 844 - DNA, 22 bp, Tribolium castaneum
cacagcaacttgtgccagaaat

SEQ ID NO: 845 - DNA, 23 bp, Tribolium castaneum
gagaaagccgaagaaatcgatgc

SEQ ID NO: 846 - DNA, 21 bp, Tribolium castaneum
gcccgcaaacgtctgggcgaa

SEQ ID NO: 847 - DNA, 22 bp, Tribolium castaneum
taaaagtgcgtgaagaccacgt

SEQ ID NO: 848 - DNA, 23 bp, Tribolium castaneum
acactgatggacggcatgaagaa

SEQ ID NO: 849 - DNA, 23 bp, Tribolium castaneum
atcggcggttgtcgcaaacaact

SEQ ID NO: 850 - DNA, 23 bp, Tribolium castaneum
cccgatgagaagatccggatgaa

SEQ ID NO: 851 - DNA, 21 bp, Tribolium castaneum
ctgccccgatgagaagatccg

SEQ ID NO: 852 - DNA, 23 bp, Tribolium castaneum
aacgaaaccggtgctttcttctt

SEQ ID NO: 853 - DNA, 23 bp, Tribolium castaneum
atcatggaatattacgagaagaa

SEQ ID NO: 854 - DNA, 26 bp, Tribolium castaneum
aacggtcccgaaattatgagtaaatt

SEQ ID NO: 855 - DNA, 24 bp, Tribolium castaneum
aacaggctgaagtatgccttgacc

SEQ ID NO: 856 - DNA, 21 bp, Tribolium castaneum
ttcatcgtccgtggtggcatg

SEQ ID NO: 857 - DNA, 21 bp, Tribolium castaneum
agttttaccggtacctggagg

SEQ ID NO: 858 - DNA, 21 bp, Tribolium castaneum
cctccaggtaccggtaaaact

SEQ ID NO: 859 - DNA, 23 bp, Tribolium castaneum
cctccaggtaccggtaaaacttt

SEQ ID NO: 860 - DNA, 26 bp, Tribolium castaneum
attaaagttttaccggtacctggagg

SEQ ID NO: 861 - DNA, 23 bp, Tribolium castaneum
ggtgctttcttcttcttaatcaa

SEQ ID NO: 862 - DNA, 21 bp, Tribolium castaneum
atcaacggtcccgaaattatg

SEQ ID NO: 863 - DNA, 510 bp, Tribolium castaneum
ctgcgaaacaggctgaagtatgccttgaccaactcagaagtgacgaagattgttatgcaaagattgattaaagttgacggaaaagttaggacagaccccaactaccccgcgggtttcatggatgttgtgactattgagaaaactggggaattcttccgcttgatttatgatgttaagggaaggttcacaatccatcgcattactggagaagaggccaaatataaattgtgcaaagtgaagaaagtacagacaggccccaagggcattcccttcttggtgacccgcgacggacgcactatcagatacccagaccccatgatcaaagtgaatgacaccattcaattggagattgccacttcgaaaattcttgattttatcaaatttgagtccggtaatttgtgtatgattactggaggtcgtaacttggggcgtgtcggtacagtggtgagccgagaacgtcacccaggttccttcgacatcgttcatattaaggatgcaaatgggcacacc

SEQ ID NO: 864 - DNA, 45 bp, Artificial sequence
  Primer sequence
gcgtaatacgactcactataggctgcgaaacaggctgaagtatgc

SEQ ID NO: 865 - DNA, 20 bp, Artificial sequence
  Primer sequence
ggtgtgcccatttgcatcct

SEQ ID NO: 866 - DNA, 23 bp, Artificial sequence
  Primer sequence
ctgcgaaacaggctgaagtatgc

SEQ ID NO: 867 - DNA, 42 bp, Artificial sequence
  Primer sequence
gcgtaatacgactcactataggggtgtgcccatttgcatcct

SEQ ID NO: 868 - DNA, 195 bp, Tribolium castaneum
catccatgttgaggtgggcatttttgagggcgtccgctgcgtttttcatcgttttgagtacggctgtgttggtgttggccccctcgagggcctcccgctgcatctcgatggtgctgagggtgccatcgatctgctggagctgcttttcgtagcgtttcttcctcttgatggcctggatggccgctgttcacaaag

SEQ ID NO: 869 - DNA, 42 bp, Artificial sequence
  Primer sequence
gcgtaatacgactcactataggcatccatgttgaggtgggca

SEQ ID NO: 870 - DNA, 20 bp, Artificial sequence
  Primer sequence
ctttgtgaacagcggccatc

SEQ ID NO: 871 - DNA, 20 bp, Artificial sequence
  Primer sequence
catccatgttgaggtgggca

SEQ ID NO: 872 - DNA, 42 bp, Artificial sequence
  Primer sequence
gcgtaatacgactcactataggctttgtgaacagcggccatc

SEQ ID NO: 873 - DNA, 284 bp, Tribolium castaneum
atgtcctggtacttgaggttcctccattgggcgattgtctcaccgtggaaaatcaaaatttggaaaaatgtgtccatgagaaggatccgatcgggttgaatggaactagtgtcgaggaggacgggttcaggggggccgttgaaactataactgtacaaaatcggctggatcataatgagactttgggtgaggtcctcccgcatcagcatgtggcggtagaacgaggtctcgtctggggagttgttgaaaacttggaggaattgggagcggcgcaaatggtacat

SEQ ID NO: 874 - DNA, 42 bp, Artificial sequence
  Primer sequence
gcgtaatacgactcactataggatgtaccatttgcgccgctc

SEQ ID NO: 875 - DNA, 25 bp, Artificial sequence
  Primer sequence
atgtcctggtacttgaggttcctcc

SEQ ID NO: 876 - DNA, 20 bp, Artificial sequence
  Primer sequence
atgtaccatttgcgccgctc

SEQ ID NO: 877 - DNA, 47 bp, Artificial sequence
  Primer sequence
gcgtaatacgactcactataggatgtcctggtacttgaggttcctcc

SEQ ID NO: 878 - DNA, 526 bp, Tribolium castaneum
caacagcgcttgaagatcatggaatattacgagaagaaggagaaaccggtggaattgcagaagaaaattcagtcgtcaaacatgctgaaccaagcccgtttgaaagtattaaaagtgcgtgaagaccacgtccacaatgtgctggatgacgcccgcaaacgtctgggcgaaatcaccaatgaccaggcgagatattcacaacttttggagtctcttatcctccagagtctctaccagtacttgggaatcagtgatgagttgtttgagaacaatatagtggtgagagtcaggcaacaggacaggagtataatccagggcattctcccagttgttgcgacgaaatacagggacgccactggtaaagacgttcatcttaaaatcgacgatgagagccacttgccatccgaaaccaccggaggagtggttttgtatgcgcaaaagggtaaaatcaagattgacaacaccttggaggctcgtttggatttaattgcacagcaacttgtgccagaaattcgtacggccttgt

SEQ ID NO: 879 - DNA, 44 bp, Artificial sequence
  Primer sequence
gcgtaatacgactcactataggcaacagcgcttgaagatcatgg

SEQ ID NO: 880 - DNA, 22 bp, Artificial sequence
  Primer sequence
acaaggccgtacgaatttctgg

SEQ ID NO: 881 - DNA, 22 bp, Artificial sequence
  Primer sequence
caacagcgcttgaagatcatgg

SEQ ID NO: 882 - DNA, 44 bp, Artificial sequence
  Primer sequence
gcgtaatacgactcactataggacaaggccgtacgaatttctgg

SEQ ID NO: 883 - DNA, 687 bp, Tribolium castaneum
cgatacagtgttgctgaaagggaagcggcggaaagagaccgtctgcattgtgctggccgacgaaaactgccccgatgagaagatccggatgaacaggatcgtcaggaataatctacgggttaggctctctgacgtcgtctggatccagccctgtcccgacgtcaaatacgggaagaggatccacgttttgcccatcgatgacacggtcgaagggctcgtcggaaatctcttcgaggtgtacttaaaaccatacttcctcgaagcttatcgaccaatccacaaaggcgacgttttcatcgtccgtggtggcatgcgagccgttgaattcaaagtggtggaaacggaaccgtcaccatattgtatcgtcgcccccgataccgtcatccattgtgacggcgatccgatcaaacgagaagaagaggaggaagccttgaacgccgtcggctacgacgatatcggcggttgtcgcaaacaactcgcacaaatcaaagaaatggtcgaattacctctacgccacccgtcgctcttcaaggccattggcgtgaaaccaccacgtggtatcctcttgtacggacctccaggtaccggtaaaactttaatcgcacgtgcagtggccaacgaaaccggtgctttcttcttcttaatcaacggtcccgaaattatgagtaaattagccggcgaatccga

SEQ ID NO: 884 - DNA, 47 bp, Artificial sequence
  Primer sequence
gcgtaatacgactcactataggcgatacagtgttgctgaaagggaag

SEQ ID NO: 885 - DNA, 22 bp, Artificial sequence
  Primer sequence
tcggattcgccggctaatttac

SEQ ID NO: 886 - DNA, 25 bp, Artificial sequence
  Primer sequence
cgatacagtgttgctgaaagggaag

SEQ ID NO: 887 - DNA, 44 bp, Artificial sequence
  Primer sequence
gcgtaatacgactcactataggtcggattcgccggctaatttac

SEQ ID NO: 888 - DNA, 734 bp, Myzus persicae
ggccccaagaagcatttgaagcgtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattgttaccaacagggaaagacatccaggatcttttgatattgttcacattaaggatgcaaatgaacatatttttgctacccggatgaacaatgtttttattattggaaaaggtcaaaagaactacatttctctaccaaggagtaagggagttaaattgactat

SEQ ID NO: 889 - protein, 244 aa, Myzus persicae
GPKKHLKRLNAPKAWMLDKSGGVFAPRPSTGPHKLRESLPLLIFLRNRLKYALTGAEVTKIVMQRLIKVDGKVRTDPNYPAGFMDVISIQKTSEHFRLIYDVKGRFTIHRITPEEAKYKLCKVKRVQTGPKGVPFLTTHDGRTIRYPDPNIKVNDTIRYDIASSKILDHIRFETGNLCMITGGRNLGRVGIVTNRERHPGSFDIVHIKDANEHIFATRMNNVFIIGKGQKNYISLPRSKGVKLT

SEQ ID NO: 890 - DNA, 396 bp, Myzus persicae
gagtttctttagtaaagtattcggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagctcatcaaaacatgaatgtagatgatgtacatgatctgatggatgacattgc

SEQ ID NO: 891 - protein, 131 aa, Myzus persicae
SFFSKVFGGKKEEKGPSTEDAIQKLRSTEEMLIKKQEFLEKKIEQEVAIAKKNGTTNKRAALQALKRKKRYEQQLAQIDGTMLTIEQQREALEGANTNTAVLTTMKTAADALKSAHQNMNVDDVHDLMDDI

SEQ ID NO: 892 - DNA, 845 bp, Myzus persicae
gtggctgcatacagttcattacgcagtatcaacattccagtggctataaacgaattagagtcaccacattagctaggaattgggcagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgcctcggtatattgacacagaacaaggtggtagtcaggcaagatttttactatgcaaagtaaacccatctcaaacacataataatatgtatgcttatggagggtgatggtggagcaccagttttgacagatgatgtaagcttgcagctgttcatggagcagccgcg

SEQ ID NO: 893 - protein, 279 aa, Myzus persicae
GCIQFITQYQHSSGYKRIRVTTLARNWADPVQNMMHVSAAFDQEASAVLMARMVVNRAETEDSPDVMRWADRTLIRLCQKFGDYQKDDPNSFRLPENFSLYPQFMYHLRRSQFLQVFNNSPDETSYYRHMLMREDVTQSLIMIQPILYSYSFNGRPEPVLLDTSSIQPDKILLMDTFFHILIFHGETIAQWRAMDYQNRPEYSNLKQLLQAPVDDAQEILKTRFPMPRYIDTEQGGSQARFLLCKVNPSQTHNNMYAYGGWWSTSFDRCKLAAVHGAAA

SEQ ID NO: 894 - DNA, 734 bp, Myzus persicae
gtgtcggaggatatgttgggccgcgttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacgtcttgctttaactgctgctgaatttttagcttaccaatgtgaaaagcatgtcttagttattttaactgacatgagttcatatgctgaagctttaagagaagtttctgctgctcgtgaagaagtacctgggcgtcgtggtttccctggttacatgtacaccgatttagctacaatttatgaacgtgctgggcgtgtagaaggaagaaatggttctatcacacaaatacctattttaactatgcctaacgacgacatcacccatcctattcc

SEQ ID NO: 895 - protein, 244 aa, Myzus persicae
VSEDMLGRVFNGSGKPIDKGPPILAEDYLDIEGQPINPYSRTYPQEMIQTGISAIDIMNSIARGQKIPIFSAAGLPHNEIAAQICRQAGLVKKPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPI

SEQ ID NO: 896 - DNA, 1041 bp, Myzus persicae
cgccgattaccaaaacaagacgtgtgttcagacattagaaggccatgctcaaaatatttctgctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttggaggttatttgttaggtgtgaaatctgttactgggttggctttatatgattgggaaaatggtaacttagttcgaagaattgagacacaacctaaacatgtattttggtcagagtctggagaattagtatgtcttgccacagatgaagcatactttattttacgttttgacgtcaatgtacttagtgctgcaagagcatccaattatgaagctgctagtcctgatggtcttgaagatgcctttgagattttaggagaagttcaagaagttgtaaaaactggtctatgggttggtgattgctttatttacaccaatggagtaaatcgtatcaactattatgttggtggtgaagttgtgacagtatccc

SEQ ID NO: 897 - protein, 345 aa, Myzus persicae
PITKTRRVFRHKAMLKIFLLVCFHPELPIVLTGSEDGTVRIWHSGTYRLESSLNYGLERVWTICCLRGSNNVALGYDEGSIMVKVGREEPAMSMDVHGGKIVWARHSEIQQANLKAMLQAEGAEIKDGERLPIQVKDMGSCEIYPQSISHNPNGRFLVVCGDGEYIIYTSMALRNKAFGSAQDFVWSSDSEYAIRENSSTIKVFKNFKEKKSFKPEGGADGIFGGYLLGVKSVTGLALYDWENGNLVRRIETQPKHVFWSESGELVCLATDEAYFILRFDVNVLSAARASNYEAASPDGLEDAFEILGEVQEVVKTGLWVGDCFIYTNGVNRINYYVGGEVVTVS

SEQ ID NO: 898 - DNA, 23 bp, Artificial sequence
  Primer sequence
ggccccaagaagcatttgaagcg

SEQ ID NO: 899 - DNA, 23 bp, Artificial sequence
  Primer sequence
  misc_feature (18)..(18): n is a, c, g, or t
cgcttgtcccgctcctcngcrat

SEQ ID NO: 900 - DNA, 27 bp, Artificial sequence
  Primer sequence
gagtttctttagtaaagtattcggtgg

SEQ ID NO: 901 - DNA, 26 bp, Artificial sequence
  Primer sequence
gcaatgtcatccatcakrtcrtgtac

SEQ ID NO: 902 - DNA, 26 bp, Artificial sequence
  Primer sequence
gtggctgcatacagttcattacgcag

SEQ ID NO: 903 - DNA, 23 bp, Artificial sequence
  Primer sequence
cgcggctgctccatgaayasytg

SEQ ID NO: 904 - DNA, 23 bp, Artificial sequence
  Primer sequence
gtgtcggaggatatgytgggycg

SEQ ID NO: 905 - DNA, 24 bp, Artificial sequence
  Primer sequence
ggaataggatgggtratrtcgtcg

SEQ ID NO: 906 - DNA, 24 bp, Artificial sequence
  Primer sequence
cgccgattaccaaaacaaracbtg

SEQ ID NO: 907 - DNA, 25 bp, Artificial sequence
  Primer sequence
gggatactgtcacaayytcdccrcc

SEQ ID NO: 908 - DNA, 21 bp, Myzus persicae
aaagcatggatgttggacaaa

SEQ ID NO: 909 - DNA, 22 bp, Myzus persicae
aaagcatggatgttggacaaat

SEQ ID NO: 910 - DNA, 29 bp, Myzus persicae
aagaagcatttgaagcgtttaaacgcacc

SEQ ID NO: 911 - DNA, 23 bp, Myzus persicae
aagcatttgaagcgtttaaacgc

SEQ ID NO: 912 - DNA, 26 bp, Myzus persicae
aagcatttgaagcgtttaaacgcacc

SEQ ID NO: 913 - DNA, 28 bp, Myzus persicae
aagtccgtaccgaccctaattatccagc

SEQ ID NO: 914 - DNA, 22 bp, Myzus persicae
acgcacccaaagcatggatgtt

SEQ ID NO: 915 - DNA, 21 bp, Myzus persicae
actattagatacgatattgca

SEQ ID NO: 916 - DNA, 50 bp, Myzus persicae
actggacccaaaggtgtgccatttttaactactcatgatggccgtactat

SEQ ID NO: 917 - DNA, 22 bp, Myzus persicae
agaagcatttgaagcgtttaaa

SEQ ID NO: 918 - DNA, 28 bp, Myzus persicae
agaagcatttgaagcgtttaaacgcacc

SEQ ID NO: 919 - DNA, 51 bp, Myzus persicae
agaagcatttgaagcgtttaaacgcacccaaagcatggatgttggacaaat

SEQ ID NO: 920 - DNA, 22 bp, Myzus persicae
agtaagggagttaaattgacta

SEQ ID NO: 921 - DNA, 22 bp, Myzus persicae
atacaagttgtgtaaagtaaag

SEQ ID NO: 922 - DNA, 71 bp, Myzus persicae
atggatgttatatctatccaaaagaccagtgagcactttagattgatctatgatgtgaaaggtcgtttcac

SEQ ID NO: 923 - DNA, 30 bp, Myzus persicae
attgatctatgatgtgaaaggtcgtttcac

SEQ ID NO: 924 - DNA, 29 bp, Myzus persicae
caaaagaccagtgagcactttagattgat

SEQ ID NO: 925 - DNA, 23 bp, Myzus persicae
cacagaattactcctgaagaagc

SEQ ID NO: 926 - DNA, 33 bp, Myzus persicae
cacagaattactcctgaagaagcaaaatacaag

SEQ ID NO: 927 - DNA, 32 bp, Myzus persicae
catccaggatcttttgatattgttcacattaa

SEQ ID NO: 928 - DNA, 59 bp, Myzus persicae
catccaggatcttttgatattgttcacattaaggatgcaaatgaacatatttttgctac

SEQ ID NO: 929 - DNA, 52 bp, Myzus persicae
catctaaaattttggatcatatccgttttgaaactggaaacttgtgcatgat

SEQ ID NO: 930 - DNA, 23 bp, Myzus persicae
catttgaagcgtttaaacgcacc

SEQ ID NO: 931 - DNA, 38 bp, Myzus persicae
catttgaagcgtttaaacgcacccaaagcatggatgtt

SEQ ID NO: 932 - DNA, 22 bp, Myzus persicae
ccaaagcatggatgttggacaa

SEQ ID NO: 933 - DNA, 28 bp, Myzus persicae
ccaaggagtaagggagttaaattgacta

SEQ ID NO: 934 - DNA, 21 bp, Myzus persicae
cccaaagcatggatgttggac

SEQ ID NO: 935 - DNA, 23 bp, Myzus persicae
cccaaagcatggatgttggacaa

SEQ ID NO: 936 - DNA, 24 bp, Myzus persicae
cccaaagcatggatgttggacaaa

SEQ ID NO: 937 - DNA, 25 bp, Myzus persicae
cccaaagcatggatgttggacaaat

SEQ ID NO: 938 - DNA, 26 bp, Myzus persicae
cgtccaagcaccggtccacacaaact

SEQ ID NO: 939 - DNA, 28 bp, Myzus persicae
ctggaaacttgtgcatgataactggagg

SEQ ID NO: 940 - DNA, 125 bp, Myzus persicae
gaaagacatccaggatcttttgatattgttcacattaaggatgcaaatgaacatatttttgctacccggatgaacaatgtttttattattggaaaaggtcaaaagaactacatttctctaccaag

SEQ ID NO: 941 - DNA, 38 bp, Myzus persicae
gatcatatccgttttgaaactggaaacttgtgcatgat

SEQ ID NO: 942 - DNA, 26 bp, Myzus persicae
gatgcaaatgaacatatttttgctac

SEQ ID NO: 943 - DNA, 23 bp, Myzus persicae
gcacccaaagcatggatgttgga

SEQ ID NO: 944 - DNA, 28 bp, Myzus persicae
gcacccaaagcatggatgttggacaaat

SEQ ID NO: 945 - DNA, 23 bp, Myzus persicae
ggatcttttgatattgttcacat

SEQ ID NO: 946 - DNA, 53 bp, Myzus persicae
ggatcttttgatattgttcacattaaggatgcaaatgaacatatttttgctac

SEQ ID NO: 947 - DNA, 28 bp, Myzus persicae
ggccccaagaagcatttgaagcgtttaa

SEQ ID NO: 948 - DNA, 26 bp, Myzus persicae
gggcgtgttggtattgttaccaacag

SEQ ID NO: 949 - DNA, 32 bp, Myzus persicae
gggcgtgttggtattgttaccaacagggaaag

SEQ ID NO: 950 - DNA, 21 bp, Myzus persicae
ggtacaaactggacccaaagg

SEQ ID NO: 951 - DNA, 41 bp, Myzus persicae
gtttttattattggaaaaggtcaaaagaactacatttctct

SEQ ID NO: 952 - DNA, 22 bp, Myzus persicae
tgaagtatgcacttactggtgc

SEQ ID NO: 953 - DNA, 38 bp, Myzus persicae
tgtaaagtaaagagggtacaaactggacccaaaggtgt

SEQ ID NO: 954 - DNA, 40 bp, Myzus persicae
tgtgtaaagtaaagagggtacaaactggacccaaaggtgt

SEQ ID NO: 955 - DNA, 113 bp, Myzus persicae
ttcttgcgtaatcgtttgaagtatgcacttactggtgccgaagtcaccaagattgtcatgcaaagattaatcaaggttgatggcaaagtccgtaccgaccctaattatccagc

SEQ ID NO: 956 - DNA, 31 bp, Myzus persicae
ttggaaaaggtcaaaagaactacatttctct

SEQ ID NO: 957 - DNA, 41 bp, Myzus persicae
ttggatcatatccgttttgaaactggaaacttgtgcatgat

SEQ ID NO: 958 - DNA, 41 bp, Myzus persicae
aaaaaaaatggtacaactaataaacgagctgcattgcaagc

SEQ ID NO: 959 - DNA, 21 bp, Myzus persicae
aagaaacggtacgaacaacaa

SEQ ID NO: 960 - DNA, 45 bp, Myzus persicae
acaagaatttttagaaaaaaaaattgaacaagaagtagcgatagc

SEQ ID NO: 961 - DNA, 38 bp, Myzus persicae
caaattgatggtaccatgttaactattgaacaacagcg

SEQ ID NO: 962 - DNA, 29 bp, Myzus persicae
gaagatgcgatacaaaagcttcgatccac

SEQ ID NO: 963 - DNA, 27 bp, Myzus persicae
gagtttctttagtaaagtattcggtgg

SEQ ID NO: 964 - DNA, 21 bp, Myzus persicae
aaaagatgatccaaatagttt

SEQ ID NO: 965 - DNA, 44 bp, Myzus persicae
aaaatattattgatggacacatttttccatattttgatattcca

SEQ ID NO: 966 - DNA, 29 bp, Myzus persicae
aatagtcctgatgaaacatcatattatag

SEQ ID NO: 967 - DNA, 101 bp, Myzus persicae
caaaaagatgatccaaatagtttccgattgccagaaaacttcagtttatatccacagttcatgtatcatttaagaaggtctcaatttctacaagtttttaa

SEQ ID NO: 968 - DNA, 26 bp, Myzus persicae
caacattccagtggctataaacgaat

SEQ ID NO: 969 - DNA, 26 bp, Myzus persicae
cacatgttgatgcgtgaagatgttac

SEQ ID NO: 970 - DNA, 59 bp, Myzus persicae
ccaattctgtatagctatagttttaatggtaggccagaacctgtacttttggataccag

SEQ ID NO: 971 - DNA, 38 bp, Myzus persicae
ccatctcaaacacataataatatgtatgcttatggagg

SEQ ID NO: 972 - DNA, 80 bp, Myzus persicae
ctcaaaactcgattcccaatgcctcggtatattgacacagaacaaggtggtagtcaggcaagatttttactatgcaaagt

SEQ ID NO: 973 - DNA, 44 bp, Myzus persicae
ggtgatggtggagcaccagttttgacagatgatgtaagcttgca

SEQ ID NO: 974 - DNA, 28 bp, Myzus persicae
gtggctgcatacagttcattacgcagta

SEQ ID NO: 975 - DNA, 37 bp, Myzus persicae
taatggctcgtatggtagtgaaccgtgctgaaactga

SEQ ID NO: 976 - DNA, 27 bp, Myzus persicae
tataggcacatgttgatgcgtgaagat

SEQ ID NO: 977 - DNA, 32 bp, Myzus persicae
tgggctgatcgtacgcttatacgcttgtgtca

SEQ ID NO: 978 - DNA, 26 bp, Myzus persicae
ttagctaggaattgggcagaccctgt

SEQ ID NO: 979 - DNA, 23 bp, Myzus persicae
aaacaagattttgaggaaaatgg

SEQ ID NO: 980 - DNA, 22 bp, Myzus persicae
aacctggtaaatcagttcttga

SEQ ID NO: 981 - DNA, 25 bp, Myzus persicae
aacgacgacatcacccatcctattc

SEQ ID NO: 982 - DNA, 26 bp, Myzus persicae
aatttagctaatgatcctactattga

SEQ ID NO: 983 - DNA, 29 bp, Myzus persicae
actatgcctaacgacgacatcacccatcc

SEQ ID NO: 984 - DNA, 35 bp, Myzus persicae
atagtatttgctgctatgggtgttaatatggaaac

SEQ ID NO: 985 - DNA, 23 bp, Myzus persicae
caaatttgtagacaagctggtct

SEQ ID NO: 986 - DNA, 53 bp, Myzus persicae
catgaagacaattttgctatagtatttgctgctatgggtgttaatatggaaac

SEQ ID NO: 987 - DNA, 71 bp, Myzus persicae
ccgatagataaaggacctcctattttggctgaagattatttggatattgaaggccaacctattaatccata

SEQ ID NO: 988 - DNA, 21 bp, Myzus persicae
cctattttggctgaagattat

SEQ ID NO: 989 - DNA, 50 bp, Myzus persicae
cgtatcattacaccacgtcttgctttaactgctgctgaatttttagctta

SEQ ID NO: 990 - DNA, 35 bp, Myzus persicae
cgtcttgctttaactgctgctgaatttttagctta

SEQ ID NO: 991 - DNA, 44 bp, Myzus persicae
gaagaagtacctgggcgtcgtggtttccctggttacatgtacac

SEQ ID NO: 992 - DNA, 50 bp, Myzus persicae
gaaggaagaaatggttctatcacacaaatacctattttaactatgcctaa

SEQ ID NO: 993 - DNA, 53 bp, Myzus persicae
gaaggaagaaatggttctatcacacaaatacctattttaactatgcctaacga

SEQ ID NO: 994 - DNA, 23 bp, Myzus persicae
gatttagctacaatttatgaacg

SEQ ID NO: 995 - DNA, 35 bp, Myzus persicae
gccagattctttaaacaagattttgaggaaaatgg

SEQ ID NO: 996 - DNA, 23 bp, Myzus persicae
gctatgggtgttaatatggaaac

SEQ ID NO: 997 - DNA, 41 bp, Myzus persicae
gctgcaggtttaccacataatgagattgctgctcaaatttg

SEQ ID NO: 998 - DNA, 65 bp, Myzus persicae
gctgggcgtgtagaaggaagaaatggttctatcacacaaatacctattttaactatgcctaacga

SEQ ID NO: 999 - DNA, 38 bp, Myzus persicae
ggttacatgtacaccgatttagctacaatttatgaacg

SEQ ID NO: 1000 - DNA, 25 bp, Myzus persicae
gtggacaaaaaattccaatattttc

SEQ ID NO: 1001 - DNA, 23 bp, Myzus persicae
gtgtcggaggatatgttgggccg

SEQ ID NO: 1002 - DNA, 33 bp, Myzus persicae
gttcttgaatttagctaatgatcctactattga

SEQ ID NO: 1003 - DNA, 53 bp, Myzus persicae
tcaatggagaatgtttgtttgttcttgaatttagctaatgatcctactattga

SEQ ID NO: 1004 - DNA, 56 bp, Myzus persicae
tcagctattgatatcatgaactctattgctcgtggacaaaaaattccaatattttc

SEQ ID NO: 1005 - DNA, 38 bp, Myzus persicae
tcatatgctgaagctttaagagaagtttctgctgctcg

SEQ ID NO: 1006 - DNA, 38 bp, Myzus persicae
tccagaacatatcctcaagaaatgattcaaactggtat

SEQ ID NO: 1007 - DNA, 26 bp, Myzus persicae
tctattgctcgtggacaaaaaattcc

SEQ ID NO: 1008 - DNA, 107 bp, Myzus persicae
tgtgaaaagcatgtcttagttattttaactgacatgagttcatatgctgaagctttaagagaagtttctgctgctcgtgaagaagtacctgggcgtcgtggtttccc

SEQ ID NO: 1009 - DNA, 68 bp, Myzus persicae
ttaactgacatgagttcatatgctgaagctttaagagaagtttctgctgctcgtgaagaagtacctgg

SEQ ID NO: 1010 - DNA, 25 bp, Myzus persicae
tttttaaaaattttaaagaaaaaaa

SEQ ID NO: 1011 - DNA, 25 bp, Myzus persicae
gatcttttgatattgttcacattaa

SEQ ID NO: 1012 - DNA, 28 bp, Myzus persicae
acatccaggatcttttgatattgttcac

SEQ ID NO: 1013 - DNA, 23 bp, Myzus persicae
tcttttgatattgttcacattaa

SEQ ID NO: 1014 - DNA, 21 bp, Myzus persicae
tattgctcgtggacaaaaaat

SEQ ID NO: 1015 - DNA, 26 bp, Myzus persicae
tctgctgctcgtgaagaagtacctgg

SEQ ID NO: 1016 - DNA, 21 bp, Myzus persicae
gctgaagattatttggatatt

SEQ ID NO: 1017 - DNA, 26 bp, Myzus persicae
ggtttaccacataatgagattgctgc

SEQ ID NO: 1018 - DNA, 35 bp, Myzus persicae
aagaaatgattcaaactggtatttcagctattgat

SEQ ID NO: 1019 - DNA, 27 bp, Myzus persicae
tattgctcgtggacaaaaaattccaat

SEQ ID NO: 1020 - DNA, 23 bp, Myzus persicae
gtttctgctgctcgtgaagaagt

SEQ ID NO: 1021 - DNA, 26 bp, Myzus persicae
cgtggtttccctggttacatgtacac

SEQ ID NO: 1022 - DNA, 23 bp, Myzus persicae
cctggttacatgtacaccgattt

SEQ ID NO: 1023 - DNA, 21 bp, Myzus persicae
tttaaaaattttaaagaaaaa

SEQ ID NO: 1024 - DNA, 24 bp, Myzus persicae
ctattatgttggtggtgaagttgt

SEQ ID NO: 1025 - DNA, 21 bp, Myzus persicae
aaagtttttaaaaattttaaa

SEQ ID NO: 1026 - DNA, 21 bp, Myzus persicae
aatttttagaaaaaaaaattg

SEQ ID NO: 1027 - DNA, 21 bp, Myzus persicae
gtcaccacattagctaggaat

SEQ ID NO: 1028 - DNA, 22 bp, Myzus persicae
aagaaatgattcaaactggtat

SEQ ID NO: 1029 - DNA, 25 bp, Myzus persicae
aagaaatgattcaaactggtatttc

SEQ ID NO: 1030 - DNA, 21 bp, Myzus persicae
catgaactctattgctcgtgg

SEQ ID NO: 1031 - DNA, 23 bp, Myzus persicae
gctgctatgggtgttaatatgga

SEQ ID NO: 1032 - DNA, 24 bp, Myzus persicae
tgctatgggtgttaatatggaaac

SEQ ID NO: 1033 - DNA, 23 bp, Myzus persicae
cctactattgagcgtatcattac

SEQ ID NO: 1034 - DNA, 32 bp, Myzus persicae
gaagtttctgctgctcgtgaagaagtacctgg

SEQ ID NO: 1035 - DNA, 23 bp, Myzus persicae
gtttctgctgctcgtgaagaagt

SEQ ID NO: 1036 - DNA, 26 bp, Myzus persicae
gtgtacatgtaaccagggaaaccacg

SEQ ID NO: 1037 - DNA, 23 bp, Myzus persicae
cctggttacatgtacaccgattt

SEQ ID NO: 1038 - DNA, 21 bp, Myzus persicae
ggttacatgtacaccgattta

SEQ ID NO: 1039 - DNA, 23 bp, Myzus persicae
cctattttaactatgcctaacga

SEQ ID NO: 1040 - DNA, 21 bp, Myzus persicae
actctccatcaccacatacta

SEQ ID NO: 1041 - DNA, 552 bp, Myzus persicae
gtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattg

SEQ ID NO: 1042 - DNA, 45 bp, Artificial sequence
  Primer sequence
gcgtaatacgactcactatagggtttaaacgcacccaaagcatgg

SEQ ID NO: 1043 - DNA, 24 bp, Artificial sequence
  Primer sequence
caataccaacacgccctaaattgc

SEQ ID NO: 1044 - DNA, 23 bp, Artificial sequence
  Primer sequence
gtttaaacgcacccaaagcatgg

SEQ ID NO: 1045 - DNA, 46 bp, Artificial sequence
  Primer sequence
gcgtaatacgactcactataggcaataccaacacgccctaaattgc

SEQ ID NO: 1046 - DNA, 323 bp, Myzus persicae
ggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagc

SEQ ID NO: 1047 - DNA, 44 bp, Artificial sequence
  Primer sequence
gcgtaatacgactcactataggggtggcaaaaaggaagagaagg

SEQ ID NO: 1048 - DNA, 23 bp, Artificial sequence
  Primer sequence
gctgatttaagtgcatctgctgc

SEQ ID NO: 1049 - DNA, 22 bp, Artificial sequence
  Primer sequence
ggtggcaaaaaggaagagaagg

SEQ ID NO: 1050 - DNA, 45 bp, Artificial sequence
  Primer sequence
gcgtaatacgactcactatagggctgatttaagtgcatctgctgc

SEQ ID NO: 1051 - DNA, 597 bp, Myzus persicae
cagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgc

SEQ ID NO: 1052 - DNA, 42 bp, Artificial sequence
  Primer sequence
gcgtaatacgactcactataggcagaccctgttcagaatatg

SEQ ID NO: 1053 - DNA, 22 bp, Artificial sequence
  Primer sequence
gcattgggaatcgagttttgag

SEQ ID NO: 1054 - DNA, 20 bp, Artificial sequence
  Primer sequence
cagaccctgttcagaatatg

SEQ ID NO: 1055 - DNA, 44 bp, Artificial sequence
  Primer sequence
gcgtaatacgactcactatagggcattgggaatcgagttttgag

SEQ ID NO: 1056 - DNA, 440 bp, Myzus persicae
gttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacg

SEQ ID NO: 1057 - DNA, 44 bp, Artificial sequence
  Primer sequence
gcgtaatacgactcactatagggttttcaatggcagtggaaagc

SEQ ID NO: 1058 - DNA, 20 bp, Artificial sequence
  Primer sequence
cgtggtgtaatgatacgctc

SEQ ID NO: 1059 - DNA, 22 bp, Artificial sequence
  Primer sequence
gttttcaatggcagtggaaagc

SEQ ID NO: 1060 - DNA, 42 bp, Artificial sequence
  Primer sequence
gcgtaatacgactcactataggcgtggtgtaatgatacgctc

SEQ ID NO: 1061 - DNA, 615 bp, Myzus persicae
gctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttgg

SEQ ID NO: 1062 - DNA, 45 bp, Artificial sequence
  Primer sequence
gcgtaatacgactcactatagggctcgtttgtttccatccagaac

SEQ ID NO: 1063 - DNA, 23 bp, Artificial sequence
  Primer sequence
ccaaaaataccatctgctccacc

SEQ ID NO: 1064 - DNA, 23 bp, Artificial sequence
  Primer sequence
gctcgtttgtttccatccagaac

SEQ ID NO: 1065 - DNA, 45 bp, Artificial sequence
  Primer sequence
gcgtaatacgactcactataggccaaaaataccatctgctccacc

SEQ ID NO: 1066 - DNA, 2616 bp, Myzus persicae
gtttaaacgcacccaaagcatggatgttggacaaatcggggggtgtcttcgctccacgtccaagcaccggtccacacaaacttcgtgaatcactaccgttattgatcttcttgcgtaatcgtttgaagtatgcacttactggtgccgaagtcaccaagattgtcatgcaaagattaatcaaggttgatggcaaagtccgtaccgaccctaattatccagccggttttatggatgttatatctatccaaaagaccagtgagcactttagattgatctatgatgtgaaaggtcgtttcaccatccacagaattactcctgaagaagcaaaatacaagttgtgtaaagtaaagagggtacaaactggacccaaaggtgtgccatttttaactactcatgatggccgtactattcgctaccctgaccctaacatcaaggttaatgacactattagatacgatattgcatcatctaaaattttggatcatatccgttttgaaactggaaacttgtgcatgataactggaggtcgcaatttagggcgtgttggtattgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcaataccaacacgccctaaattgcgacctccagttatcatgcacaagtttccagtttcaaaacggatatgatccaaaattttagatgatgcaatatcgtatctaatagtgtcattaaccttgatgttagggtcagggtagcgaatagtacggccatcatgagtagttaaaaatggcacacctttgggtccagtttgtaccctctttactttacacaacttgtattttgcttcttcaggagtaattctgtggatggtgaaacgacctttcacatcatagatcaatctaaagtgctcactggtcttttggatagatataacatccataaaaccggctggataattagggtcggtacggactttgccatcaaccttgattaatctttgcatgacaatcttggtgacttcggcaccagtaagtgcatacttcaaacgattacgcaagaagatcaataacggtagtgattcacgaagtttgtgtggaccggtgcttggacgtggagcgaagacaccccccgatttgtccaacatccatgctttgggtgcgtttaaac

SEQ ID NO: 1067 - DNA, 2158 bp, Myzus persicae
gctgatttaagtgcatctgctgcagttttcatggtagtcaatactgctgtatttgtgttggcaccttctaatgcctcccgctgttgttcaatagttaacatggtaccatcaatttgggctaattgttgttcgtaccgtttcttacgcttcaatgcttgcaatgcagctcgtttattagttgtaccattttttttggctatcgctacttcttgttcaatttttttttctaaaaattcttgtttctttatcagcatctcttcagtggatcgaagcttttgtatcgcatcttcggttgatggtcccttctcttcctttttgccaccaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttggtggcaaaaaggaagagaagggaccatcaaccgaagatgcgatacaaaagcttcgatccactgaagagatgctgataaagaaacaagaatttttagaaaaaaaaattgaacaagaagtagcgatagccaaaaaaaatggtacaactaataaacgagctgcattgcaagcattgaagcgtaagaaacggtacgaacaacaattagcccaaattgatggtaccatgttaactattgaacaacagcgggaggcattagaaggtgccaacacaaatacagcagtattgactaccatgaaaactgcagcagatgcacttaaatcagc

SEQ ID NO: 1068 - DNA, 2706 bp, Myzus persicae
cagaccctgttcagaatatgatgcatgttagtgctgcatttgatcaagaagcatctgccgttttaatggctcgtatggtagtgaaccgtgctgaaactgaggatagtccagatgtgatgcgttgggctgatcgtacgcttatacgcttgtgtcaaaaatttggtgattatcaaaaagatgatccaaatagtttccgattgccagaaaacttcagtttatatccacagttcatgtatcatttaagaaggtctcaatttctacaagtttttaataatagtcctgatgaaacatcatattataggcacatgttgatgcgtgaagatgttacccaaagtttaatcatgatacagccaattctgtatagctatagttttaatggtaggccagaacctgtacttttggataccagtagtattcaacctgataaaatattattgatggacacatttttccatattttgatattccatggagagactattgctcaatggagagcaatggattatcaaaatagaccagagtatagtaacctcaagcagttgcttcaagcccccgttgatgatgctcaggaaattctcaaaactcgattcccaatgcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgcattgggaatcgagttttgagaatttcctgagcatcatcaacgggggcttgaagcaactgcttgaggttactatactctggtctattttgataatccattgctctccattgagcaatagtctctccatggaatatcaaaatatggaaaaatgtgtccatcaataatattttatcaggttgaatactactggtatccaaaagtacaggttctggcctaccattaaaactatagctatacagaattggctgtatcatgattaaactttgggtaacatcttcacgcatcaacatgtgcctataatatgatgtttcatcaggactattattaaaaacttgtagaaattgagaccttcttaaatgatacatgaactgtggatataaactgaagttttctggcaatcggaaactatttggatcatctttttgataatcaccaaatttttgacacaagcgtataagcgtacgatcagcccaacgcatcacatctggactatcctcagtttcagcacggttcactaccatacgagccattaaaacggcagatgcttcttgatcaaatgcagcactaacatgcatcatattctgaacagggtctg

SEQ ID NO: 1069 - DNA, 2392 bp, Myzus persicae
gttttcaatggcagtggaaagccgatagataaaggacctcctattttggctgaagattatttggatattgaaggccaacctattaatccatactccagaacatatcctcaagaaatgattcaaactggtatttcagctattgatatcatgaactctattgctcgtggacaaaaaattccaatattttcagctgcaggtttaccacataatgagattgctgctcaaatttgtagacaagctggtctcgttaaaaaacctggtaaatcagttcttgacgatcatgaagacaattttgctatagtatttgctgctatgggtgttaatatggaaacagccagattctttaaacaagattttgaggaaaatggttcaatggagaatgtttgtttgttcttgaatttagctaatgatcctactattgagcgtatcattacaccacgaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttcgtggtgtaatgatacgctcaatagtaggatcattagctaaattcaagaacaaacaaacattctccattgaaccattttcctcaaaatcttgtttaaagaatctggctgtttccatattaacacccatagcagcaaatactatagcaaaattgtcttcatgatcgtcaagaactgatttaccaggttttttaacgagaccagcttgtctacaaatttgagcagcaatctcattatgtggtaaacctgcagctgaaaatattggaattttttgtccacgagcaatagagttcatgatatcaatagctgaaataccagtttgaatcatttcttgaggatatgttctggagtatggattaataggttggccttcaatatccaaataatcttcagccaaaataggaggtcctttatctatcggctttccactgccattgaaaac

SEQ ID NO: 1070 - DNA, 2742 bp, Myzus persicae
ccaaaaataccatctgctccaccttctggtttaaaagactttttttctttaaaatttttaaaaactttgattgtagaagaattttctctaatggcatactcagaatcagaagaccatacaaaatcctgagcggagccaaatgctttattacgcaaagccattgatgtatatataatatactctccatcaccacatactactaaaaatctaccattcggattatgagatattgactgtggataaatttcacagctacccatgtctttaacttgtattggtaaacgttcaccatctttgatttcggctccttctgcttgaagcatcgctttaaggttagcttgttgaatttcactatgacgtgcccaaacaattttacccccatgaacatccattgacattgctggctcttcacgaccaactttaaccattatacttccttcatcataacctagagctacattattagatccccgtaagcaacagattgtccatacacgttctaacccatagtttaatgatgattctaatcgataagtaccagaatgccaaattctgacggtaccatcttctgagccagttaacacgatgggaagttctggatggaaacaaacgagcaagggcgaattcgacccagctttcttgtacaaagtggtgatatcactagtgcggccgcctgcaggtcgaccatatggtcgacctgcaggcggccgcactagtgatgctgttatgttcagtgtcaagctgacctgcaaacacgttaaatgctaagaagttagaatatatgagacacgttaactggtatatgaataagctgtaaataaccgagtataaactcattaactaatatcacctctagagtataatataatcaaattcgacaatttgactttcaagagtaggctaatgtaaaatctttatatatttctacaatgttcaaagaaacagttgcatctaaacccctatggccatcaaattcaatgaacgctaagctgatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatcagcttaatatgactctcaataaagtctcataccaacaagtgccaccttattcaaccatcaagaaaaaagccaaaatttatgctactctaaggaaaacttcactaaagaagacgatttagagtgttttaccaagaatttctgtcatcttactaaacaactaaagatcggtgtgatacaaaacctaatctcattaaagtttatgctaaaataagcataattttacccactaagcgtgaccagataaacataactcagcacaccagagcatatatattggtggctcaaatcatagaaacttacagtgaagacacagaaagccgtaagaagaggcaagagtatgaaaccttacctcatcatttccatgaggttgcttctgatcccgcgggatatcaccactttgtacaagaaagctgggtcgaattcgcccttgctcgtttgtttccatccagaacttcccatcgtgttaactggctcagaagatggtaccgtcagaatttggcattctggtacttatcgattagaatcatcattaaactatgggttagaacgtgtatggacaatctgttgcttacggggatctaataatgtagctctaggttatgatgaaggaagtataatggttaaagttggtcgtgaagagccagcaatgtcaatggatgttcatgggggtaaaattgtttgggcacgtcatagtgaaattcaacaagctaaccttaaagcgatgcttcaagcagaaggagccgaaatcaaagatggtgaacgtttaccaatacaagttaaagacatgggtagctgtgaaatttatccacagtcaatatctcataatccgaatggtagatttttagtagtatgtggtgatggagagtatattatatatacatcaatggctttgcgtaataaagcatttggctccgctcaggattttgtatggtcttctgattctgagtatgccattagagaaaattcttctacaatcaaagtttttaaaaattttaaagaaaaaaagtcttttaaaccagaaggtggagcagatggtatttttgg

SEQ ID NO: 1071 - DNA, 697 bp, Nilaparvata lugens
gaaatcatggatgttggacaaattgggtggtgtgtatgcaccccgacccagcacaggtccacacaagctgcgagaatctctcccacttgtcatatttttgcgtaatcggctcaagtacgctttaactaactgtgaagtgaagaaaattgtgatgcagcgtctcatcaaggttgacggcaaagtgaggactgaccccaactatcctgcaggttttatggacgttgttcaaatcgaaaagacaaacgagttcttccgtttgatctatgatgttaagggacgtttcaccatccacaggatcacagctgaagaagctaagtacaagctgtgcaaagtgaagagggttcagacaggacccaagggcattccatttttgaccactcacgatggacgcaccatcaggtatccagaccccttggtaaaagtcaatgacaccatccaattggacattgccacatccaaaatcatggacttcatcagattcgactctggtaacctgtgtatgatcactggaggtcgtaacttgggtcgtgtgggcactgtcgtgaacagggagcgacacccggggtctttcgacatcgtgcacatcaaggacgtgttgggacacacttttgccactaggttgaacaacgttttcatcatcggcaagggtagtaaagcatacgtgtctctgcccaagggcaagggtgtgaagctcagt

SEQ ID NO: 1072 - protein, 232 aa, Nilaparvata lugens
KSWMLDKLGGVYAPRPSTGPHKLRESLPLVIFLRNRLKYALTNCEVKKIVMQRLIKVDGKVRTDPNYPAGFMDVVQIEKTNEFFRLIYDVKGRFTIHRITAEEAKYKLCKVKRVQTGPKGIPFLTTHDGRTIRYPDPLVKVNDTIQLDIATSKIMDFIRFDSGNLCMITGGRNLGRVGTVVNRERHPGSFDIVHIKDVLGHTFATRLNNVFIIGKGSKAYVSLPKGKGVKLS

SEQ ID NO: 1073 - DNA, 336 bp, Nilaparvata lugens
gatgaaaagggccctacaactggcgaagccattcagaaactacgcgaaacagaggaaatgctgataaagaaacaagactttttagaaaagaaaattgaagttgaaattggagttgccaggaagaatggaacaaaaaacaaaagagccgcgatccaggcactcaaaaggaagaagaggtatgaaaagcaattgcagcagatcgatggaacgttatcaacaattgagatgcagagagaggccctcgaaggagccaacacgaatacggccgtactgcaaactatgaagaacgcagcagatgctctcaaagcggctcatcaacacatggatgtggatcag

SEQ ID NO: 1074 - protein, 112 aa, Nilaparvata lugens
DEKGPTTGEAIQKLRETEEMLIKKQDFLEKKIEVEIGVARKNGTKNKRAAIQALKRKKRYEKQLQQIDGTLSTIEMQREALEGANTNTAVLQTMKNAADALKAAHQHMDVDQ

SEQ ID NO: 1075 - DNA, 477 bp, Nilaparvata lugens
tccgcgtcgtccttacgagaaggcacgtctcgaacaggagttgaagatcatcggagagtatggactccgtaacaagcgtgaggtgtggagagtcaaatacgccctggccaagattcgtaaggccgctcgtgagctgttgactctggaagagaaggaccagaaacgtttgtttgaaggtaacgccctgctgcgtcgcctggtgcgtattggagtgttggacgaaggaagaatgaagctcgattacgtcttgggtttaaaaattgaagatttccttgaacgtcgtctacagactcaggtgtacaaactcggtttggccaagtccatccatcacgcccgtgtactcatcagacaaagacatatcagagtgcgcaaacaagtagtgaacattccgagctttgtggtgcgcctggactcgcagaagcacattgacttctcgctgaagtcgccgttcggcggtggccgacctggtcgcgtcaa

SEQ ID NO: 1076 - protein, 158 aa, Nilaparvata lugens
PRRPYEKARLEQELKIIGEYGLRNKREVWRVKYALAKIRKAARELLTLEEKDQKRLFEGNALLRRLVRIGVLDEGRMKLDYVLGLKIEDFLERRLQTQVYKLGLAKSIHHARVLIRQRHIRVRKQVVNIPSFVVRLDSQKHIDFSLKSPFGGGRPGRV

SEQ ID NO: 1077 - DNA, 339 bp, Nilaparvata lugens
aaggagttggctgctgtaagaactgtctgctctcacatcgaaaacatgctgaagggagtcacaaagggattcctgtacaagatgcgtgccgtgtacgcccatttccccatcaactgtgtgacgaccgagaacaactctgtgatcgaggtgcgtaacttcctgggcgagaagtacatccgacgggtgaggatggcgcccggcgtcactgttaccaactcgacaaagcagaaggacgagctcatcgtcgaaggaaacagcatagaggacgtgtcaagatcagctgccctcatccaacagtcaacaacagtgaagaacaaggatattcgtaaattcttggac

SEQ ID NO: 1078 - protein, 113 aa, Nilaparvata lugens
KELAAVRTVCSHIENMLKGVTKGFLYKMRAVYAHFPINCVTTENNSVIEVRNFLGEKYIRRVRMAPGVTVTNSTKQKDELIVEGNSIEDVSRSAALIQQSTTVKNKDIRKFLD

SEQ ID NO: 1079 - DNA, 453 bp, Nilaparvata lugens
ttggatcccaatgaaataaatgaaatcgcaaacacaaattcacgtcaaagcatcaggaagctgatcaaagacggtcttatcatcaagaaaccggttgcagtacattcacgtgctcgcgttcgtaaaaacactgaagccaggaggaaaggcagacattgtggctttggtaagaggaaaggtacagccaacgcccgtatgccacaaaaggttctatgggtgaatcgtatgcgtgtcttgagaagactgttgaaaaaatacagacaagataagaaaatcgacaggcatctgtaccatcacctttacatgaaggctaagggtaacgtattcaagaacaagcgtgtattgatggagttcattcataagaagaaggccgagaaagcaagaatgaagatgttgaacgaccaggctgaagctcgcagacaaaaggtcaaggaggccaagaagcgaagggaa

SEQ ID NO: 1080 - protein, 151 aa, Nilaparvata lugens
LDPNEINEIANTNSRQSIRKLIKDGLIIKKPVAVHSRARVRKNTEARRKGRHCGFGKRKGTANARMPQKVLWVNRMRVLRRLLKKYRQDKKIDRHLYHHLYMKAKGNVFKNKRVLMEFIHKKKAEKARMKMLNDQAEARRQKVKEAKKRRE

SEQ ID NO: 1081 - DNA, 1052 bp, Nilaparvata lugens
aagtgcttgtgtcaagtggtgtggtggagtacattgacaccctggaggaggagacgaccatgatagcgatgtcgccggatgacctgcgtcaggacaaggagtatgcctactgtaccacctacacgcactgcgagatccacccggccatgatactcggtgtgtgcgcctctattattcccttccccgatcacaaccaaagtcccaggaacacctatcagagcgctatggggaaacaggcgatgggcgtgtacatcaccaacttccacgtgcgaatggacacgctggctcacgtgctgttctacccgcacaagccactggtcaccactcgctccatggagtacctgcgcttcagggagcttcctgccggcatcaactctgtggtcgccatcgcctgctacactggatacaaccaggaggacagtgtcattctcaacgcctccgctgtcgagcgcggattcttcagatcggttttcttccgatcttacaaagatgcagaatcgaagcgtattggcgaccaagaggagcaattcgagaagcccaccagacagacgtgtcagggaatgaggaatgccatttatgacaaattggacgatgatggcatcattgctcccggtctgagagtgtctggtgacgatgtggttattggcaaaaccataacactgcccgataatgatgacgagctggaaggtacaacaaagaggttcacgaagagagatgccagtactttcctgcgtaacagtgagacgggaatcgtcgaccaagtcatgttaaccttgaactctgagggttacaagttctgcaaaattcgagtcaggtctgtgcgtatcccgcagattggcgataagttcgcttcccgacatggccaaaaaggaacgtgtggaatacagtatcgtcaagaggacatgccttttacaagcgagggaatcgcaccggatattattatcaatcctcacgctatcccatctcgtatgacaattggccatttaattgaatgtctccaaggaaaggtgtcgtcgaacaagggcgagataggtgacgcgacgccgttcaac

SEQ ID NO: 1082 - protein, 350 aa, Nilaparvata lugens
VLVSSGVVEYIDTLEEETTMIAMSPDDLRQDKEYAYCTTYTHCEIHPAMILGVCASIIPFPDHNQSPRNTYQSAMGKQAMGVYITNFHVRMDTLAHVLFYPHKPLVTTRSMEYLRFRELPAGINSVVAIACYTGYNQEDSVILNASAVERGFFRSVFFRSYKDAESKRIGDQEEQFEKPTRQTCQGMRNAIYDKLDDDGIIAPGLRVSGDDVVIGKTITLPDNDDELEGTTKRFTKRDASTFLRNSETGIVDQVMLTLNSEGYKFCKIRVRSVRIPQIGDKFASRHGQKGTCGIQYRQEDMPFTSEGIAPDIIINPHAIPSRMTIGHLIECLQGKVSSNKGEIGDATPFN

SEQ ID NO: 1083 - DNA, 958 bp, Nilaparvata lugens
tttcagagatttccttctgaaacctgaaattttgagagcaatccttgactgtggttttgaacatccatctgaagtacaacatgaatgcattcctcaagctgtacttggaatggacatattgtgtcaagcgaaatccggtatgggaaaaactgctgtatttgtgttggcgacattacagcaaattgaaccaactgacaaccaagtcagtgtattggtcatgtgtcataccagagagcttgcattccaaatcagcaaagagtatgaacgattttcgaaatgtatgccaaatatcaaggttggagttttcttcggcggactgccgattcagagggatgaggagacgttgaaattgaactgtcctcacatcgtggttggaacacccggacgaattttggcgttggtacgcaacaagaagctggacctcaagcatctcaagcactttgtccttgacgaatgtgacaaaatgttggaactgttagatatgcgaagagatgtgcaggaaatattccgaaacacgccgcacagcaaacaagtcatgatgttcagtgcaactctcagcaaagaaattcgtccagtctgcaagaaattcatgcaagatccgatggaagtgtacgttgatgacgaggccaagctgacgcttcacggcctgcagcagcactatgtcaaactcaaagaaaacgaaaagaacaaaaagttatttgaattacttgacatacttgaattcaaccaggttgttatatttgtgaagtcagtgcagcgctgcatggccctatcgcaactcctaacagagcagaacttccctgcagtggctattcaccgtggcatgacacaagaagaacgattgaagaaatatcaagagttcaaagagttcctaaagcgaattttggtagcaacgaatctgtttggcagaggaatggatattgagagagtcaacattgtattcaactatgacatgcct

SEQ ID NO: 1084 - protein, 319 aa, Nilaparvata lugens
FRDFLLKPEILRAILDCGFEHPSEVQHECIPQAVLGMDILCQAKSGMGKTAVFVLATLQQIEPTDNQVSVLVMCHTRELAFQISKEYERFSKCMPNIKVGVFFGGLPIQRDEETLKLNCPHIVVGTPGRILALVRNKKLDLKHLKHFVLDECDKMLELLDMRRDVQEIFRNTPHSKQVMMFSATLSKEIRPVCKKFMQDPMEVYVDDEAKLTLHGLQQHYVKLKENEKNKKLFELLDILEFNQVVIFVKSVQRCMALSQLLTEQNFPAVAIHRGMTQEERLKKYQEFKEFLKRILVATNLFGRGMDIERVNIVFNYDMP

SEQ ID NO: 1085 - DNA, 675 bp, Nilaparvata lugens
ggaaggatagaaaaccagaaacgagttgttggtgttcttttgggatgctggagacctggaggtgtattagatgtttcaaacagttttgcagttccatttgatgaggacgacaaagaaaagaatgtttggttcttagaccatgattacttggaaaacatgttcgggatgttcaagaaagttaatgctagagaaaaggttgtgggttggtaccatactggacccaaactccaccaaaacgatgttgcaatcaatgagttgattcgtcgttactgtccaaactgtgtcttagtcataatcgatgccaagcctaaagatttgggtctacctacagaggcatacagagtcgttgaagaaatccatgatgatggatcgccaacatcaaaaacatttgaacatgtgatgagtgagattggggcagaagaggctgaggagattggcgttgaacatctgttgagagacatcaaagatacaacagtcgggtcactgtcacagcgcgtcacaaatcagctgatgggcttgaagggcttgcatctgcaattacaggatatgcgagactatttgaatcaggttgtcgaaggaaagttgccaatgaaccatcaaatcgtttaccaactgcaagacatcttcaaccttctacccgatatcggccacggcaattttgtagactcgctctac

SEQ ID NO: 1086 - protein, 225 aa, Nilaparvata lugens
GRIENQKRVVGVLLGCWRPGGVLDVSNSFAVPFDEDDKEKNVWFLDHDYLENMFGMFKKVNAREKVVGWYHTGPKLHQNDVAINELIRRYCPNCVLVIIDAKPKDLGLPTEAYRVVEEIHDDGSPTSKTFEHVMSEIGAEEAEEIGVEHLLRDIKDTTVGSLSQRVTNQLMGLKGLHLQLQDMRDYLNQVVEGKLPMNHQIVYQLQDIFNLLPDIGHGNFVDSLY

SEQ ID NO: 1087 - DNA, 363 bp, Nilaparvata lugens
tgcgactatgatcgaccgccgggacgcggtcaggtgtgcgacgtcgacgtcaagaactggtttccctgcacctctgagaacaatttcaactaccatcaatcgagcccttgtgtttttctcaaactgaacaagataattggttggcaaccggagtactacaatgagactgaaggctttccagataatatgccaggtgacctcaagcgacacattgcccaacagaagagtatcaacaagctgtttatgcaaacaatctggataacttgcgaaggagagggtcctctagacaaggagaatgcaggggagatccagtacatccctagacagggatttccgggctacttctacccttacactaatgcc

SEQ ID NO: 1088 - protein, 121 aa, Nilaparvata lugens
CDYDRPPGRGQVCDVDVKNWFPCTSENNFNYHQSSPCVFLKLNKIIGWQPEYYNETEGFPDNMPGDLKRHIAQQKSINKLFMQTIWITCEGEGPLDKENAGEIQYIPRQGFPGYFYPYTNA

SEQ ID NO: 1089 - DNA, 769 bp, Nilaparvata lugens
gtccagtcgactggaagccaccaggcttgttgttcccgttggatgtctgtatcaacctttgaaggagagacctgatctaccgcctgtacagtacgatccagttctttgtactaggaatacttgtcgtgcaattctgaatccattgtgccaagtcgactatcgagccaagctatgggtctgcaacttttgtttccagaggaatcctttcccccctcaatatgcagctatttcggagcagcatcaaccagcagaactgataccttcattttccaccatcgaatacatcattaccagagcgcaaacgatgccgccgatgttcgtgctggtggtggacacatgtctggacgacgaggagctgggagctttgaaggactcactgcagatgtcgctgtcgctgctgccgcccaatgcactcatcggtctcatcacgttcggcaaaatggtgcaggtgcacgagcttggctgcgacggctgctcgaagagctacgtgttccgtggcgtgaaggacctgactgccaagcagatccaggacatgttgggcattggcaagatggccgccgctccacagcccatgcaacagcgcattcccggcgccgctccctccgcacctgtcaacagatttcttcagcctgtcggaaagtgcgatatgagtttaactgatctgcttggggaattgcaaagagatccatggaatgtggctcagggcaagagacctctccgatctactggagttgcattgtccattgcagttggtctgctcgagtgcaca

SEQ ID NO: 1090 - protein, 256 aa, Nilaparvata lugens
SSRLEATRLVVPVGCLYQPLKERPDLPPVQYDPVLCTRNTCRAILNPLCQVDYRAKLWVCNFCFQRNPFPPQYAAISEQHQPAELIPSFSTIEYIITRAQTMPPMFVLVVDTCLDDEELGALKDSLQMSLSLLPPNALIGLITFGKMVQVHELGCDGCSKSYVFRGVKDLTAKQIQDMLGIGKMAAAPQPMQQRIPGAAPSAPVNRFLQPVGKCDMSLTDLLGELQRDPWNVAQGKRPLRSTGVALSIAVGLLECT

SEQ ID NO: 1091 - DNA, 527 bp, Nilaparvata lugens
agatggtggtaccggcaaaactacatttgtcaaacgacatcttaccggagaatttgaaaagaagtatgttgccacccttggagttgaagttcacccccttgtatttcacacaaacagaggtgtgattaggttcaatgtgtgggacacagctggccaggaaaagttcggtggacttcgtgatggatattacattcagggacaatgcgccatcattatgtttgacgtaacgtcaagagtcacctacaagaacgttcccaactggcacagagatttagtgagggtttgcgaaaacattcccattgtactatgcggcaacaaagtagacatcaaggacaggaaagtcaaggccaagagcatagtcttccataggaagaagaaccttcagtactacgacatcagtgcgaaaagcaactacaacttcgagaagccgttcctgtggttggcaaagaagctgatcggtgaccccaacctggagttcgtcgccatgcccgccctcctcccacccgaggtcacaatggacccccaat

SEQ ID NO: 1092 - protein, 176 aa, Nilaparvata lugens
  misc_feature (176)..(176): Xaa can be any naturally occurring amino acid
DGGTGKTTFVKRHLTGEFEKKYVATLGVEVHPLVFHTNRGVIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLAKKLIGDPNLEFVAMPALLPPEVTMDPQX

SEQ ID NO: 1093 - DNA, 169 bp, Nilaparvata lugens
gcagcagacgcaggcacaggtagacgaggttgtcgatataatgaaaacaaacgttgagaaagtattggagagggatcaaaaactatcagaattggatgatcgagcagatgctctacagcaaggcgcttcacagtttgaacagcaagctggcaaactcaagaggaaattc

SEQ ID NO: 1094 - protein, 56 aa, Nilaparvata lugens
QQTQAQVDEVVDIMKTNVEKVLERDQKLSELDDRADALQQGASQFEQQAGKLKRKF

SEQ ID NO: 1095 - DNA, 355 bp, Nilaparvata lugens
cgcagagcaagtctacatctcttcactggccttattgaaaatgcttaagcacggtcgcgccggtgttcccatggaagttatgggcctaatgctgggcgaatttgtagacgactacactgtgcgtgtcattgatgtattcgctatgccacagagtggaacgggagtgagtgtggaggctgtagacccggtgttccaagcgaagatgttggacatgctaaagcagacaggacggcccgagatggtggtgggctggtaccactcgcacccgggcttcggctgctggctgtcgggtgtcgacatcaacacgcaggagagcttcgagcaactatccaagagagccgttgccgtcgtcgtc

SEQ ID NO: 1096 - protein, 118 aa, Nilaparvata lugens
AEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQESFEQLSKRAVAVVV

SEQ ID NO: 1097 - DNA, 598 bp, Nilaparvata lugens
tttcattgagcaagaagccaatgagaaagccgaagagatcgatgccaaggccgaggaagaattcaacattgaaaagggaaggctcgtacagcaccagcgccttaaaatcatggagtactatgacaggaaagagaagcaggttgagctccagaaaaaaatccaatcgtcaaacatgctgaaccaagcgcgtctgaaggcactgaaggtgcgcgaagatcacgtgagaagtgtgctcgaagaatccagaaaacgtcttggagaagtaaccagaaacccagccaagtacaaggaagtcctccagtatctaattgtccaaggactcctgcagctgctagaatcaaacgtagtactgcgcgtgcgcgaggctgacgtgagtctgatcgagggcattgttggctcatgcgcagagcagtacgcgaagatgaccggcaaagaggtggtggtgaagctggacgctgacaacttcctggccgccgagacgtgtggaggcgtcgagttgttcgcccgcaacggccgcatcaagatccccaacaccctcgagtccaggctcgacctcatctcccagcaacttgtgcccgagattagagtcgcgctcttt

SEQ ID NO: 1098 - protein, 199 aa, Nilaparvata lugens
FIEQEANEKAEEIDAKAEEEFNIEKGRLVQHQRLKIMEYYDRKEKQVELQKKIQSSNMLNQARLKALKVREDHVRSVLEESRKRLGEVTRNPAKYKEVLQYLIVQGLLQLLESNVVLRVREADVSLIEGIVGSCAEQYAKMTGKEVVVKLDADNFLAAETCGGVELFARNGRIKIPNTLESRLDLISQQLVPEIRVALF

SEQ ID NO: 1099 - DNA, 986 bp, Nilaparvata lugens
attgtgctgtctgacgagacatgtccgttcgaaaagatccgcatgaatcgagtggtcaggaagaatctgcgagtgcgcttgtccgacattgtctcgatccagccttgcccagacgtcaagtatggaaagcgtatccatgtgctgcccattgatgataccgttgagggtcttacaggaaatctgttcgaagtgtatttgaagccatacttcctggaagcatacaggccaattcacaaggatgatgcattcattgttcgcggaggtatgagagcggtcgaattcaaggtggttgaaacagatccatcgccctactgcattgtcgcgccagacaccgtcatccattgtgagggagaccccatcaaacgtgaggatgaagaagacgcagcaaacgcagtcggctacgacgacattggaggctgcagaaagcagctggcgcagatcaaagagatggtggagttgccgctgagacatcccagtctgttcaaggcgatcggcgtgaagccgccacgaggcatcctgctgtacggaccaccgggaaccggaaagacgttgatagcgcgcgccgtcgccaacgaaacgggcgccttcttcttcctcatcaacggacccgagattatgagcaaattggccggcgagtcggagagtaacctgcgcaaagctttcgaggaagcggacaaaaacgcaccggccatcatcttcatcgatgagctggacgcaatcgcgccaaaacgcgagaagacgcacggcgaggtggagcgacgcatcgtgtcgcagctgctgacgctgatggacggtctcaagcagagctcgcacgtgattgtcatggccgccaccaatcggcccaactcgatcgatgccgcgcttaggcgctttggccgctttgatcgcgaaatcgacattggcattcccgatgccaccggtcgtctcgaggtgctgcgcatccacaccaagaacatgaagttggctgatgacgtcgatttggaaca

SEQ ID NO: 1100 - protein, 329 aa, Nilaparvata lugens
  misc_feature (329)..(329): Xaa can be any naturally occurring amino acid
IVLSDETCPFEKIRMNRVVRKNLRVRLSDIVSIQPCPDVKYGKRIHVLPIDDTVEGLTGNLFEVYLKPYFLEAYRPIHKDDAFIVRGGMRAVEFKVVETDPSPYCIVAPDTVIHCEGDPIKREDEEDAANAVGYDDIGGCRKQLAQIKEMVELPLRHPSLFKAIGVKPPRGILLYGPPGTGKTLIARAVANETGAFFFLINGPEIMSKLAGESESNLRKAFEEADKNAPAIIFIDELDAIAPKREKTHGEVERRIVSQLLTLMDGLKQSSHVIVMAATNRPNSIDAALRRFGRFDREIDIGIPDATGRLEVLRIHTKNMKLADDVDLEX

SEQ ID NO: 1101 - DNA, 691 bp, Nilaparvata lugens
gacgccagtatcagaagacatgcttggtcgtgtattcaacggaagtggtaagcccatcgacaaaggacctcccattcttgctgaggattatctcgacattcaaggtcaacccatcaatccttggtcgcgtatctatcccgaggaaatgatccagactggaatttcagccatcgacgtcatgaactcgattgctcgtggccagaaaatccccatcttttcagctgccggtctacctcacaacgaaattgctgctcaaatctgtagacaggctggtcttgtcaaactgccaggaaagtcagttctcgatgactctgaggacaactttgctattgtattcgcagccatgggagtcaacatggaaactgctcgattcttcaaacaggatttcgaggagaacggctctatggagaacgtgtgcctgttcttgaacctggcgaacgacccgacgatcgagcgtatcatcacaccacgcctggcgctgacggccgccgagttcctggcctaccagtgcgagaagcacgtgctcgtcatcctcaccgacatgagctcctacgccgaggcgctgcgagaggtgtccgccgcccgcgaggaggtgcccggccgtcgtggtttccccggttacatgtacaccgatctggccaccatctacgagcgcgccggacgagtcgagggtcgcaacggctccatcacg

SEQ ID NO: 1102 - protein, 230 aa, Nilaparvata lugens
TPVSEDMLGRVFNGSGKPIDKGPPILAEDYLDIQGQPINPWSRIYPEEMIQTGISAIDVMNSIARGQKIPIFSAAGLPHNEIAAQICRQAGLVKLPGKSVLDDSEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSIT

SEQ ID NO: 1103 - DNA, 1099 bp, Nilaparvata lugens
tatgcaaatgcctgtgccacgcccacaaatagaaagcacacaacagtttattcgatccgagaaaacaacatactcgaatggattcaccaccattgaggaggacttcaaagtagacactttcgaataccgtcttctgcgcgaggtgtcgttccgcgaatctctgatcagaaactacttgcacgaggcggacatgcagatgtcgacggtggtggaccgagcattgggtcccccctcggcgccacacatccagcagaagccgcgcaactcaaaaatccaggagggcggcgatgccgtcttttccatcaagctcagcgccaaccccaagcctcggctggtctggttcaagaacggtcagcgcatcggtcagacgcagaaacaccaggcctcctactccaatcagaccgccacgctcaaggtcaacaaagtcagcgctcaagactccggccactacacgctgcttgctgaaaatccgcaaggatgtactgtgtcctcagcttacctagctgtcgaatcagctggcactcaagatacaggatacagtgagcaatacagcagacaagaggtggagacgacagaggcggtggacagcagcaagatgctggcaccgaactttgttcgcgtgccggccgatcgcgacgcgagcgaaggcaagatgacgcggtttgactgccgcgtgacgggccgaccctacccggacgtggcctggttcatcaacggccaacaggtggctgacgacgccacgcacaagatcctcgtcaacgagtctggcaaccactcgctcatgatcaccggcgtcactcgcttggaccacggagtggtcggctgtattgcccgcaacaaggctggcgaaacctcattccagtgcaacttgaatgtgatcgagaaagaactggttgtggcgccgaaatttgtggagagattcgcacaagtgaatgtgaaggagggtgagccggttgtgctgagcgcacgcgctgttggcacacctgttccaagaataacatggcagaaggacggcgccccgatccagtcgggaccgagcgtgagtctgtttgtggacggaggtgcgaccagcctggacatcccgtacgcgaaggcgtcg

SEQ ID NO: 1104 - protein, 366 aa, Nilaparvata lugens
MQMPVPRPQIESTQQFIRSEKTTYSNGFTTIEEDFKVDTFEYRLLREVSFRESLIRNYLHEADMQMSTVVDRALGPPSAPHIQQKPRNSKIQEGGDAVFSIKLSANPKPRLVWFKNGQRIGQTQKHQASYSNQTATLKVNKVSAQDSGHYTLLAENPQGCTVSSAYLAVESAGTQDTGYSEQYSRQEVETTEAVDSSKMLAPNFVRVPADRDASEGKMTRFDCRVTGRPYPDVAWFINGQQVADDATHKILVNESGNHSLMITGVTRLDHGVVGCIARNKAGETSFQCNLNVIEKELVVAPKFVERFAQVNVKEGEPVVLSARAVGTPVPRITWQKDGAPIQSGPSVSLFVDGGATSLDIPYAKAS

SEQ ID NO: 1105 - DNA, 402 bp, Nilaparvata lugens
cgatgacacatacacagaaagttacatcagtaccattggtgtagattttaaaattagaacaatagatctcgatggaaaaaccataaagcttcagatttgggacacggccggccaggagcggttccgcacgatcacatcgagctactaccggggcgcccacggcatcattgtggtgtacgactgcaccgaccaggagtcgttcaacaacctcaaacagtggctcgaggagattgaccgctacgcctgtgataatgtcaacaaactgctcgtcggcaacaagtgtgatcagaccaacaaaaaggtcgtcgactatacacaggctaaggaatacgccgaccagctgggcattccgttcctggagacgtcggcgaagaacgcgaccaatgtggagcaggcgttcat

SEQ ID NO: 1106 - protein, 133 aa, Nilaparvata lugens
DDTYTESYISTIGVDFKIRTIDLDGKTIKLQIWDTAGQERFRTITSSYYRGAHGIIVVYDCTDQESFNNLKQWLEEIDRYACDNVNKLLVGNKCDQTNKKVVDYTQAKEYADQLGIPFLETSAKNATNVEQAF

SEQ ID NO: 1107 - DNA, 493 bp, Nilaparvata lugens
cgtcagtctcaattctgtcaccgatatcagcaccacgttcattctcaagccacaagagaacgtgaagataacgcttgagggcgcacaggcctgtttcatttcacacgaacgacttgtgatctcactgaagggaggagaactctatgttctaactctctattccgatagtatgcgcagtgtgaggagttttcatctggagaaagctgctgccagtgtcttgactacttgtatctgtgtttgtgaggagaactatctgttccttggttcccgtcttggaaactcactgttgctcaggtttactgagaaggaattgaacctgattgagccgagggccatcgaaagctcacagtcccagaatccggccaagaagaaaaagctggatactttgggagattggatggcatctgacgtcactgaaatacgcgacctggatgaactagaagtgtatggcagtgaaacacaaacctctatgcaaattgcatcctacatattc

SEQ ID NO: 1108 - protein, 164 aa, Nilaparvata lugens
VSLNSVTDISTTFILKPQENVKITLEGAQACFISHERLVISLKGGELYVLTLYSDSMRSVRSFHLEKAAASVLTTCICVCEENYLFLGSRLGNSLLLRFTEKELNLIEPRAIESSQSQNPAKKKKLDTLGDWMASDVTEIRDLDELEVYGSETQTSMQIASYIF

SEQ ID NO: 1109 - DNA, 721 bp, Nilaparvata lugens
tacattgcacagagaattcctttccgagccagatctgcaatcttacagtgttatgataattgatgaagctcacgagaggacgttgcacactgatatactgttcggtttggtgaaagatgtcgcccgattcagacctgacttgaagctgctcatatcaagcgccacactggatgctcagaaattctccgagtttttcgacgatgcacccatcttcaggattccgggccgtagatttccggtggacatctactacacaaaggcgcccgaggctgactacgtggacgcatgtgtcgtttcgatcctgcagatccacgccactcagccgctgggagacatcctggtcttcctcaccggtcaggaggagatcgaaacctgccaggagctgctgcaggacagagtgcgcaggcttgggcctcgtatcaaggagctgctcatattgcccgtctattccaacctacccagtgatatgcaggcaaagattttcctgcccactccaccaaatgctagaaaggtagtattggccacaaatattgcagaaacctcattgaccatcgacaatataatctacgtgattgatcctggtttttgtaagcagaataacttcaattcaaggactggaatggaatcgcttgttgtagtgcctgtttcaaaggcatcggccaatcagcgagcagggcgggcgggacgggtggcggccggcaagtgcttccgtctgtacacg

SEQ ID NO: 1110 - protein, 240 aa, Nilaparvata lugens
TLHREFLSEPDLQSYSVMIIDEAHERTLHTDILFGLVKDVARFRPDLKLLISSATLDAQKFSEFFDDAPIFRIPGRRFPVDIYYTKAPEADYVDACVVSILQIHATQPLGDILVFLTGQEEIETCQELLQDRVRRLGPRIKELLILPVYSNLPSDMQAKIFLPTPPNARKVVLATNIAETSLTIDNIIYVIDPGFCKQNNFNSRTGMESLVVVPVSKASANQRAGRAGRVAAGKCFRLYT

SEQ ID NO: 1111 - DNA, 1681 bp, Nilaparvata lugens
ccggagcttctctcaggaacgccagcacgaggaaatgaaggaatcctcgggtcgcatgcatcacagcgatcctctaatcgtcgagactcatagcggtcacgtgagaggaatctcgaagaccgtcctcggacgggaggtccacgtgtttaccgggattccgtttgcgaaacctcccatcggtccgttgcgattccgtaaaccggttcccgtcgacccgtggcacggcgttctggatgcgaccgcgcttcccaacagctgctaccaggaacggtacgagtatttcccgggcttcgagggagaggaaatgtggaatccgaatacgaatttgtccgaagattgtctgtatttgaacatatgggtgccgcaccggttgagaatccgacacagagccaacagcgaggagaataaaccaagagcgaaggtgccggtgctgatctggatctacggcgggggttacatgagcggcacagctacactggacgtgtacgatgctgacatggtggccgccacgagtgacgtcatcgtcgcctccatgcagtaccgagtgggtgcgttcggcttcctctacctcgcacaggacttgcctcgaggcagcgaggaggcgccgggcaacatggggctctgggaccaggcccttgccatccgctggctcaaggacaacattgccgccttcggaggcgatcccgaactcatgacgctctttggcgagtcggctgggggtggatctgtaagcatccacttggtatcaccgataactcgcggcctagcgcgtcgtggcatcatgcagtcaggaacgatgaacgcaccgtggagcttcatgacggcggaacgcgcgaccgaaatcgccaagacgctcattgacgactgcggctgcaactcgtcgctcctgaccgacgctcccagtcgcgtcatgtcctgtatgcgatcagtcgaggcaaagatcatctccgtgcagcaatggaacagctactccggcattctcggacttccgtctgcacccaccatcgacggcattttcctgcccaaacatcccctcgatctgctcaaggaaggcgactttcaggacactgaaatactcatcggcagtaatcaggatgagggtacctacttcatattgtacgatttcatcgacttcttccaaaaagacgggccgagtttcttgcaaagagataagttcctagacatcatcaacacaattttcaagaatatgacgaaaattgagagggaagctatcatattccagtacacagattgggagcatgttatggatggttatctgaaccagaaaatgatcggagatgtggttggtgattacttcttcatctgtccgacaaatcatttcgcacaggcattcgcagagcatggaaagaaggtgtattactatttcttcacccagagaaccagtacaagtttatggggcgagtggatgggagtcatgcatggagatgaaatagaatacgtttttggtcatcctctcaacatgtcgctgcaattcaatgctagggaaagggatctcagtctgcgaataatgcaagcttactctaggtttgcattgacaggtaaaccagtgcctgatgacgtgaattggcctatctactccaaggaccagccgcagtattacattttcaatgcggagacttcgggcacaggcagaggacccagagcaacagcgtgtgctttc

SEQ ID NO: 1112 - protein, 560 aa, Nilaparvata lugens
RSFSQERQHEEMKESSGRMHHSDPLIVETHSGHVRGISKTVLGREVHVFTGIPFAKPPIGPLRFRKPVPVDPWHGVLDATALPNSCYQERYEYFPGFEGEEMWNPNTNLSEDCLYLNIWVPHRLRIRHRANSEENKPRAKVPVLIWIYGGGYMSGTATLDVYDADMVAATSDVIVASMQYRVGAFGFLYLAQDLPRGSEEAPGNMGLWDQALAIRWLKDNIAAFGGDPELMTLFGESAGGGSVSIHLVSPITRGLARRGIMQSGTMNAPWSFMTAERATEIAKTLIDDCGCNSSLLTDAPSRVMSCMRSVEAKIISVQQWNSYSGILGLPSAPTIDGIFLPKHPLDLLKEGDFQDTEILIGSNQDEGTYFILYDFIDFFQKDGPSFLQRDKFLDIINTIFKNMTKIEREAIIFQYTDWEHVMDGYLNQKMIGDVVGDYFFICPTNHFAQAFAEHGKKVYYYFFTQRTSTSLWGEWMGVMHGDEIEYVFGHPLNMSLQFNARERDLSLRIMQAYSRFALTGKPVPDDVNWPIYSKDQPQYYIFNAETSGTGRGPRATACAF

SEQ ID NO: 1113 - DNA, 850 bp, Nilaparvata lugens
agaagacggcacggtgcgtatttggcactcgggcacctacaggctggagtcctcgctgaattatggcctcgaaagagtgtggaccatttgctgcatgcgaggatccaacaatgtggctcttggctacgacgaaggcagcataatggtgaaggtgggtcgggaggagccggccatctcgatggatgtgaacggtgagaagattgtgtgggcgcgccactcggagatacaacaggtcaacctcaaggccatgccggagggcgtcgaaatcaaagatggcgaacgactgccggtcgccgttaaggatatgggcagctgtgaaatatatccgcagaccatcgctcataatcccaacggcagattcctagtcgtttgtggagatggagagtacataattcacacatcaatggtgctaagaaataaggcgtttggctcggcccaagagttcatttggggacaggactcgtccgagtatgctatcagagaaggaacatccactgtcaaagtattcaaaaacttcaaagaaaagaaatcattcaagccagaatttggtgctgagagcatattcggcggctacctgctgggagtttgttcgttgtctggactggcgctgtacgactgggagaccctggagctggtgcgtcgcatcgagatccaaccgaaacacgtgtactggtcggagagtggggagctggtggcgctggccactgatgactcctactttgtgctccgctacgacgcacaggccgtgctcgctgcacgcgacgccggtgacgacgctgtcacgccggacggcgtcgaggatgcattcgaggtccttggtgaagtgcacgaaactgtaaaaactggattg

SEQ ID NO: 1114 - protein, 299 aa, Nilaparvata lugens
PIVLTGSEDGTVRIWHSGTYRLESSLNYGLERVWTICCMRGSNNVALGYDEGSIMVKVGREEPAISMDVNGEKIVWARHSEIQQVNLKAMPEGVEIKDGERLPVAVKDMGSCEIYPQTIAHNPNGRFLVVCGDGEYIIHTSMVLRNKAFGSAQEFIWGQDSSEYAIREGTSTVKVFKNFKEKKSFKPEFGAESIFGGYLLGVCSLSGLALYDWETLELVRRIEIQPKHVYWSESGELVALATDDSYFVLRYDAQAVLAARDAGDDAVTPDGVEDAFEVLGEVHETVKTGLWVGDCFIYT

SEQ ID NO: 1115 - DNA, 751 bp, Nilaparvata lugens
cgttgaacgtgaaaggctcgtgtgtgtcagacactgacattggcttgggcggcacctctcaatggaaaatgtgcgccttcactccacacacaacttgtgcattcttcttcgaagttgtcaaccagcacgcagccccaatcccacagggaggaagaggatgcatccaattcattacgcaataccaacattccagtggccagagaaggatacgtgtcaccaccatcgctcgaaactgggcagatgcgagcaccaacctggcacacatcagtgccggcttcgaccaggaggcaggagccgtgctgatggcccgcatggtcgtgcatcgcgccgagactgacgatggacctgacgtcatgcgctgggctgaccgcatgctcatccgtctctgtcagaggttcggtgaatacagtaaggatgaccctaacagtttccgtctgccagagaacttcacactttatccgcagttcatgtaccatctgcgtcgatcccaattcttgcaagtgttcaacaacagtcctgatgaaacatcttactacaggcacattcttatgcgagaggatctgactcagagtttgattatgatccagccgattttgtacagctacagcttcaatggtccccccgagccagtgctgctcgacaccagcagtattcaacccgacagaatcctattgatggacacatttttccaaattctcattttccatggagagacgattgctcaatggcgatctctgggctaccaggacat

SEQ ID NO: 1116 - protein, 240 aa, Nilaparvata lugens
LNVKGSCVSDTDIGLGGTSQWKMCAFTPHTTCAFFFEVVNQHAAPIPQGGRGCIQFITQYQHSSGQRRIRVTTIARNWADASTNLAHISAGFDQEAGAVLMARMVVHRAETDDGPDVMRWADRMLIRLCQRFGEYSKDDPNSFRLPENFTLYPQFMYHLRRSQFLQVFNNSPDETSYYRHILMREDLTQSLIMIQPILYSYSFNGPPEPVLLDTSSIQPDRILLMDTFFQILIFHGETIA

SEQ ID NO: 1117 - DNA, 26 bp, Artificial sequence
  Primer sequence
gaaatcatggatgttggacaaattgg

SEQ ID NO: 1118 - DNA, 22 bp, Artificial sequence
  Primer sequence
actgagcttcacacccttgccc

SEQ ID NO: 1119 - DNA, 24 bp, Artificial sequence
  Primer sequence
gatgaaaagggccctacaactggc

SEQ ID NO: 1120 - DNA, 26 bp, Artificial sequence
  Primer sequence
ctgatccacatccatgtgttgatgag

SEQ ID NO: 1121 - DNA, 24 bp, Artificial sequence
  Primer sequence
tccgcgtcgtccttacgagaaggc

SEQ ID NO: 1122 - DNA, 22 bp, Artificial sequence
  Primer sequence
ttgacgcgaccaggtcggccac

SEQ ID NO: 1123 - DNA, 28 bp, Artificial sequence
  Primer sequence
tgaaggtggagaarggttyggmwcmaag

SEQ ID NO: 1124 - DNA, 26 bp, Artificial sequence
  Primer sequence
gtcgtcttctcdgahacrtavagacc

SEQ ID NO: 1125 - DNA, 30 bp, Artificial sequence; identical to SEQ ID NO: 613
  Primer sequence

SEQ ID NO: 1126 - DNA, 26 bp, Artificial sequence
  Primer sequence
tcctgcttcttsgyrgcratwcgytc

SEQ ID NO: 1127 - DNA, 29 bp, Artificial sequence
  Primer sequence
ggagcgagactacaacaaykayrgytggc

SEQ ID NO: 1128 - DNA, 26 bp, Artificial sequence
  Primer sequence
gagatcttctgcacrttkacvgcatc

SEQ ID NO: 1129 - DNA, 22 bp, Artificial sequence
  Primer sequence
cggtgtccattcacagytccgg

SEQ ID NO: 1130 - DNA, 26 bp, Artificial sequence
  Primer sequence
cgatgcaagtaggtgtckgartcytc

SEQ ID NO: 1131 - DNA, 24 bp, Artificial sequence
  Primer sequence
gtggtggatcacttyaaycgkatg

SEQ ID NO: 1132 - DNA, 24 bp, Artificial sequence
  Primer sequence
gcgcatttgatcgttbgtyttcac

SEQ ID NO: 1133 - DNA, 25 bp, Artificial sequence
  Primer sequence
gggccgtggtcagaayatywayaac

SEQ ID NO: 1134 - DNA, 25 bp, Artificial sequence
  Primer sequence
ccgccaaaggactsarrtadccctc

SEQ ID NO: 1135 - DNA, 23 bp, Artificial sequence
  Primer sequence
cggctgacgtggaaygtktggcc

SEQ ID NO: 1136 - DNA, 24 bp, Artificial sequence
  Primer sequence
tgccggaagttctcrtaytckggc

SEQ ID NO: 1137 - DNA, 26 bp, Artificial sequence
  Primer sequence
cccactttcaagtgygtrytrgtcgg

SEQ ID NO: 1138 - DNA, 25 bp, Artificial sequence
  Primer sequence
cgctctctctcgatctgydsctgcc

SEQ ID NO: 1139 - DNA, 21 bp, Artificial sequence
  Primer sequence
gcaggcgcaggtbgabgargt

SEQ ID NO: 1140 - DNA, 24 bp, Artificial sequence
  Primer sequence
gaatttcctcttsagyttbccvgc

SEQ ID NO: 1141 - DNA, 22 bp, Artificial sequence
  Primer sequence
cagatgcgcccgtbgtdgayac

SEQ ID NO: 1142 - DNA, 24 bp, Artificial sequence
  Primer sequence
gcccttgacagaytgdatvggatc

SEQ ID NO: 1143 - DNA, 24 bp, Artificial sequence
  Primer sequence
gcccttgacagaytgdatvggatc

SEQ ID NO: 1144 - DNA, 24 bp, Artificial sequence
  Primer sequence
gaacttgcggttgabgttscgdcc

SEQ ID NO: 1145 - DNA, 20 bp, Artificial sequence
  Primer sequence
gccgcaaggagacbgtvtgc

SEQ ID NO: 1146 - DNA, 23 bp, Artificial sequence
  Primer sequence
gtccgtgggaytcrgchgcaatc

SEQ ID NO: 1147 - DNA, 21 bp, Artificial sequence
  Primer sequence
gttcaccggcgayatyctgcg

SEQ ID NO: 1148 - DNA, 24 bp, Artificial sequence
  Primer sequence
cggcatagtcagaatsggratctg

SEQ ID NO: 1149 - DNA, 25 bp, Artificial sequence
  Primer sequence
  misc_feature (20)..(20): n is a, c, g, or t
gctccgtctacathcarccngargg

SEQ ID NO: 1150 - DNA, 23 bp, Artificial sequence
  Primer sequence
gtgcatcggtaccahschgcrtc

SEQ ID NO: 1151 - DNA, 24 bp, Artificial sequence
  Primer sequence
gtcctgtctgctgctvmgwttygc

SEQ ID NO: 1152 - DNA, 23 bp, Artificial sequence
  Primer sequence
ccttgatctchgcmgccatbgtc

SEQ ID NO: 1153 - DNA, 26 bp, Artificial sequence
  Primer sequence
ctcaatcagagcgtycchccrtaygg

SEQ ID NO: 1154 - DNA, 21 bp, Artificial sequence
  Primer sequence
ggaattgccsagvcgdgadcc

SEQ ID NO: 1155 - DNA, 25 bp, Artificial sequence
  Primer sequence
gcgtgctcaagtayatgacbgaygg

SEQ ID NO: 1156 - DNA, 25 bp, Artificial sequence
  Primer sequence
  misc_feature (17)..(17): n is a, c, g, or t
  misc_feature (23)..(23): n is a, c, g, or t
ccagttcatgcttrtangcccangc

SEQ ID NO: 1157 - DNA, 22 bp, Artificial sequence
  Primer sequence
ccggagcttctctcaggaacgc

SEQ ID NO: 1158 - DNA, 23 bp, Artificial sequence
  Primer sequence
gaaagcacacgctgttgctctgg

SEQ ID NO: 1159 - DNA, 21 bp, Artificial sequence
  Primer sequence
gccgatcgtkytvackggctc

SEQ ID NO: 1160 - DNA, 27 bp, Artificial sequence
  Primer sequence
ggtatagatgaarcartcdccvaccca

SEQ ID NO: 1161 - DNA, 22 bp, Nilaparvata lugens
ctgaagaagctaagtacaagct

SEQ ID NO: 1162 - DNA, 26 bp, Nilaparvata lugens
ttcttccgtttgatctatgatgttaa

SEQ ID NO: 1163 - DNA, 22 bp, Nilaparvata lugens
cagctgaagaagctaagtacaa

SEQ ID NO: 1164 - DNA, 29 bp, Nilaparvata lugens
gagttcttccgtttgatctatgatgttaa

SEQ ID NO: 1165 - DNA, 24 bp, Nilaparvata lugens
aagtacaagctgtgcaaagtgaag

SEQ ID NO: 1166 - DNA, 24 bp, Nilaparvata lugens
ttcgacatcgtgcacatcaaggac

SEQ ID NO: 1167 - DNA, 27 bp, Nilaparvata lugens
atcacagctgaagaagctaagtacaag

SEQ ID NO: 1168 - DNA, 25 bp, Nilaparvata lugens
tgtgtatgatcactggaggtcgtaa

SEQ ID NO: 1169 - DNA, 21 bp, Nilaparvata lugens
aacgttttcatcatcggcaag

SEQ ID NO: 1170 - DNA, 21 bp, Nilaparvata lugens
ccaaaatcatggacttcatca

SEQ ID NO: 1171 - DNA, 22 bp, Nilaparvata lugens
tgatctatgatgttaagggacg

SEQ ID NO: 1172 - DNA, 22 bp, Nilaparvata lugens
catggatgttggacaaattggg

SEQ ID NO: 1173 - DNA, 24 bp, Nilaparvata lugens
ttttgccactaggttgaacaacgt

SEQ ID NO: 1174 - DNA, 27 bp, Nilaparvata lugens
gcagcgtctcatcaaggttgacggcaa

SEQ ID NO: 1175 - DNA, 21 bp, Nilaparvata lugens
aagggacgtttcaccatccac

SEQ ID NO: 1176 - DNA, 23 bp, Nilaparvata lugens
aacctgtgtatgatcactggagg

SEQ ID NO: 1177 - DNA, 26 bp, Nilaparvata lugens
actaactgtgaagtgaagaaaattgt

SEQ ID NO: 1178 - DNA, 23 bp, Nilaparvata lugens
ttcttccgtttgatctatgatgt

SEQ ID NO: 1179 - DNA, 29 bp, Nilaparvata lugens
tgtatgatcactggaggtcgtaacttggg

SEQ ID NO: 1180 - DNA, 25 bp, Nilaparvata lugens
catggatgttggacaaattgggtgg

SEQ ID NO: 1181 - DNA, 21 bp, Nilaparvata lugens
gctgaagaagctaagtacaag

SEQ ID NO: 1182 - DNA, 23 bp, Nilaparvata lugens
ggaggtcgtaacttgggtcgtgt

SEQ ID NO: 1183 - DNA, 26 bp, Nilaparvata lugens
tatgatgttaagggacgtttcaccat

SEQ ID NO: 1184 - DNA, 22 bp, Nilaparvata lugens
catggatgttggacaaattggg

SEQ ID NO: 1185 - DNA, 22 bp, Nilaparvata lugens
ctgaagaagctaagtacaagct

SEQ ID NO: 1186 - DNA, 23 bp, Nilaparvata lugens
gaagaagctaagtacaagctgtg

SEQ ID NO: 1187 - DNA, 26 bp, Nilaparvata lugens
ttgcacagcttgtacttagcttcttc

SEQ ID NO: 1188 - DNA, 24 bp, Nilaparvata lugens
aagtacaagctgtgcaaagtgaag

SEQ ID NO: 1189 - DNA, 29 bp, Nilaparvata lugens
atgatcactggaggtcgtaacttgggtcg

SEQ ID NO: 1190 - DNA, 23 bp, Nilaparvata lugens
ggtcgtaacttgggtcgtgtggg

SEQ ID NO: 1191 - DNA, 24 bp, Nilaparvata lugens
ttcgacatcgtgcacatcaaggac

SEQ ID NO: 1192 - DNA, 21 bp, Nilaparvata lugens
acatcgtgcacatcaaggacg

SEQ ID NO: 1193 - DNA, 29 bp, Nilaparvata lugens
caggagttgaagatcatcggagagtatgg

SEQ ID NO: 1194 - DNA, 21 bp, Nilaparvata lugens
cgtaaggccgctcgtgagctg

SEQ ID NO: 1195 - DNA, 22 bp, Nilaparvata lugens
aaggtaacgccctgctgcgtcg

SEQ ID NO: 1196 - DNA, 26 bp, Nilaparvata lugens
caggagttgaagatcatcggagagta

SEQ ID NO: 1197 - DNA, 23 bp, Nilaparvata lugens
gccaagtccatccatcacgcccg

SEQ ID NO: 1198 - DNA, 21 bp, Nilaparvata lugens
aagtccatccatcacgcccgt

SEQ ID NO: 1199 - DNA, 22 bp, Nilaparvata lugens
tgtttgaaggtaacgccctgct

SEQ ID NO: 1200 - DNA, 23 bp, Nilaparvata lugens
caggagttgaagatcatcggaga

SEQ ID NO: 1201 - DNA, 26 bp, Nilaparvata lugens
gtgcgcctggactcgcagaagcacat

SEQ ID NO: 1202 - DNA, 23 bp, Nilaparvata lugens
gagttgaagatcatcggagagta

SEQ ID NO: 1203 - DNA, 24 bp, Nilaparvata lugens
ttgggtttaaaaattgaagatttc

SEQ ID NO: 1204 - DNA, 23 bp, Nilaparvata lugens
tcgcagaagcacattgacttctc

SEQ ID NO: 1205 - DNA, 21 bp, Nilaparvata lugens
agaatgaagctcgattacgtc

SEQ ID NO: 1206 - DNA, 21 bp, Nilaparvata lugens
tttgtggtgcgcctggactcg

SEQ ID NO: 1207 - DNA, 28 bp, Nilaparvata lugens
agaagcacattgacttctcgctgaagtc

SEQ ID NO: 1208 - DNA, 26 bp, Nilaparvata lugens
tcgcagaagcacattgacttctcgct

SEQ ID NO: 1209 - DNA, 26 bp, Nilaparvata lugens
ctcatcagacaaagacatatcagagt

SEQ ID NO: 1210 - DNA, 23 bp, Nilaparvata lugens
ttgaagatcatcggagagtatgg

SEQ ID NO: 1211 - DNA, 21 bp, Nilaparvata lugens
aaaattgaagatttccttgaa

SEQ ID NO: 1212 - DNA, 23 bp, Nilaparvata lugens
cagaagcacattgacttctcgct

SEQ ID NO: 1213 - DNA, 21 bp, Nilaparvata lugens
cgtaaggccgctcgtgagctg

SEQ ID NO: 1214 - DNA, 23 bp, Nilaparvata lugens
gcgtgatggatggacttggccaa

SEQ ID NO: 1215 - DNA, 23 bp, Nilaparvata lugens
gccaagtccatccatcacgcccg

SEQ ID NO: 1216 - DNA, 24 bp, Nilaparvata lugens
gccaagtccatccatcacgcccgt

SEQ ID NO: 1217 - DNA, 26 bp, Nilaparvata lugens
ctcatcagacaaagacatatcagagt

SEQ ID NO: 1218 - DNA, 23 bp, Nilaparvata lugens
caggagttgaagatcatcggaga

SEQ ID NO: 1219 - DNA, 29 bp, Nilaparvata lugens
caggagttgaagatcatcggagagtatgg

SEQ ID NO: 1220 - DNA, 23 bp, Nilaparvata lugens
gagttgaagatcatcggagagta

SEQ ID NO: 1221 - DNA, 23 bp, Nilaparvata lugens
tcgcagaagcacattgacttctc

SEQ ID NO: 1222 - DNA, 23 bp, Nilaparvata lugens
ttgaagatcatcggagagtatgg

SEQ ID NO: 1223 - DNA, 26 bp, Nilaparvata lugens
cagaagcacattgacttctcgctgaa

SEQ ID NO: 1224 - DNA, 24 bp, Nilaparvata lugens
ctccgtaacaagcgtgaggtgtgg

SEQ ID NO: 1225 - DNA, 21 bp, Nilaparvata lugens
cgtaacaagcgtgaggtgtgg

SEQ ID NO: 1226 - DNA, 23 bp, Nilaparvata lugens
gtcaaatacgccctggccaagat

SEQ ID NO: 1227 - DNA, 26 bp, Nilaparvata lugens
tacgcccatttccccatcaactgtgt

SEQ ID NO: 1228 - DNA, 21 bp, Nilaparvata lugens
tgctctcacatcgaaaacatg

SEQ ID NO: 1229 - DNA, 24 bp, Nilaparvata lugens
aacttcctgggcgagaagtacatc

SEQ ID NO: 1230 - DNA, 29 bp, Nilaparvata lugens
gccgtgtacgcccatttccccatcaactg

SEQ ID NO: 1231 - DNA, 32 bp, Nilaparvata lugens
gtgtacgcccatttccccatcaactgtgtgac

SEQ ID NO: 1232 - DNA, 29 bp, Nilaparvata lugens
gtgtacgcccatttccccatcaactgtgt

SEQ ID NO: 1233 - DNA, 23 bp, Nilaparvata lugens
atgcgtgccgtgtacgcccattt

SEQ ID NO: 1234 - DNA, 23 bp, Nilaparvata lugens
tcagctgccctcatccaacagtc

SEQ ID NO: 1235 - DNA, 23 bp, Nilaparvata lugens
aaggatattcgtaaattcttgga

SEQ ID NO: 1236 - DNA, 23 bp, Nilaparvata lugens
gcccatttccccatcaactgtgt

SEQ ID NO: 1237 - DNA, 23 bp, Nilaparvata lugens
aacttcctgggcgagaagtacat

SEQ ID NO: 1238 - DNA, 29 bp, Nilaparvata lugens
aagaacaaggatattcgtaaattcttgga

SEQ ID NO: 1239 - DNA, 26 bp, Nilaparvata lugens
aacttcctgggcgagaagtacatccg

SEQ ID NO: 1240 - DNA, 23 bp, Nilaparvata lugens
catttccccatcaactgtgtgac

SEQ ID NO: 1241 - DNA, 29 bp, Nilaparvata lugens
cgtaacttcctgggcgagaagtacatccg

SEQ ID NO: 1242 - DNA, 23 bp, Nilaparvata lugens
agatcagctgccctcatccaaca

SEQ ID NO: 1243 - DNA, 29 bp, Nilaparvata lugens
gtgtacgcccatttccccatcaactgtgt

SEQ ID NO: 1244 - DNA, 24 bp, Nilaparvata lugens
tacgcccatttccccatcaactgt

SEQ ID NO: 1245 - DNA, 26 bp, Nilaparvata lugens
tacgcccatttccccatcaactgtgt

SEQ ID NO: 1246 - DNA, 23 bp, Nilaparvata lugens
gcccatttccccatcaactgtgt

SEQ ID NO: 1247 - DNA, 23 bp, Nilaparvata lugens
acacagttgatggggaaatgggc

SEQ ID NO: 1248 - DNA, 23 bp, Nilaparvata lugens
gcccatttccccatcaactgtgt

SEQ ID NO: 1249 - DNA, 26 bp, Nilaparvata lugens
gtcacacagttgatggggaaatgggc

SEQ ID NO: 1250 - DNA, 21 bp, Nilaparvata lugens
ccatttccccatcaactgtgt

SEQ ID NO: 1251 - DNA, 26 bp, Nilaparvata lugens
aagggtaacgtattcaagaacaagcg

SEQ ID NO: 1252 - DNA, 24 bp, Nilaparvata lugens
aagggtaacgtattcaagaacaag

SEQ ID NO: 1253 - DNA, 23 bp, Nilaparvata lugens
cgtgtattgatggagttcattca

SEQ ID NO: 1254 - DNA, 22 bp, Nilaparvata lugens
aaaggtcaaggaggccaagaag

SEQ ID NO: 1255 - DNA, 26 bp, Nilaparvata lugens
aagatgttgaacgaccaggctgaagc

SEQ ID NO: 1256 - DNA, 23 bp, Nilaparvata lugens
acgttacccttagccttcatgta

SEQ ID NO: 1257 - DNA, 26 bp, Nilaparvata lugens
aagggtaacgtattcaagaacaagcg

SEQ ID NO: 1258 - DNA, 23 bp, Nilaparvata lugens
cgtgtattgatggagttcattca

SEQ ID NO: 1259 - DNA, 21 bp, Nilaparvata lugens
aggtcaaggaggccaagaagc

SEQ ID NO: 1260 - DNA, 23 bp, Nilaparvata lugens
acgttacccttagccttcatgta

SEQ ID NO: 1261 - DNA, 26 bp, Nilaparvata lugens
aagggtaacgtattcaagaacaagcg

SEQ ID NO: 1262 - DNA, 21 bp, Nilaparvata lugens
agtcccaggaacacctatcag

SEQ ID NO: 1263 - DNA, 23 bp, Nilaparvata lugens
attattcccttccccgatcacaa

SEQ ID NO: 1264 - DNA, 29 bp, Nilaparvata lugens
cacgctatcccatctcgtatgacaattgg

SEQ ID NO: 1265 - DNA, 23 bp, Nilaparvata lugens
tacaagttctgcaaaattcgagt

SEQ ID NO: 1266 - DNA, 26 bp, Nilaparvata lugens
atgacaattggccatttaattgaatg

SEQ ID NO: 1267 - DNA, 23 bp, Nilaparvata lugens
acctacacgcactgcgagatcca

SEQ ID NO: 1268 - DNA, 23 bp, Nilaparvata lugens
ggtgtggtggagtacattgacac

SEQ ID NO: 1269 - DNA, 23 bp, Nilaparvata lugens
attattcccttccccgatcacaa

SEQ ID NO: 1270 - DNA, 21 bp, Nilaparvata lugens
agtcccaggaacacctatcag

SEQ ID NO: 1271 - DNA, 29 bp, Nilaparvata lugens
cacgctatcccatctcgtatgacaattgg

SEQ ID NO: 1272 - DNA, 23 bp, Nilaparvata lugens
tctcgtatgacaattggccattt

SEQ ID NO: 1273 - DNA, 22 bp, Nilaparvata lugens
gcaaacaagtcatgatgttcag

SEQ ID NO: 1274 - DNA, 29 bp, Nilaparvata lugens
ggtatgggaaaaactgctgtatttgtgtt

SEQ ID NO: 1275 - DNA, 21 bp, Nilaparvata lugens
gaatgcattcctcaagctgta

SEQ ID NO: 1276 - DNA, 23 bp, Nilaparvata lugens
tgcaagaaattcatgcaagatcc

SEQ ID NO: 1277 - DNA, 23 bp, Nilaparvata lugens
ttccaaatcagcaaagagtatga

SEQ ID NO: 1278 - DNA, 23 bp, Nilaparvata lugens
gatgacgaggccaagctgacgct

SEQ ID NO: 1279 - DNA, 32 bp, Nilaparvata lugens
tgtggttttgaacatccatctgaagtacaaca

SEQ ID NO: 1280 - DNA, 21 bp, Nilaparvata lugens
gaaaacgaaaagaacaaaaag

SEQ ID NO: 1281 - DNA, 29 bp, Nilaparvata lugens
ggtatgggaaaaactgctgtatttgtgtt

SEQ ID NO: 1282 - DNA, 22 bp, Nilaparvata lugens
gcaaacaagtcatgatgttcag

SEQ ID NO: 1283 - DNA, 26 bp, Nilaparvata lugens
ctgcagcagcactatgtcaaactcaa

SEQ ID NO: 1284 - DNA, 21 bp, Nilaparvata lugens
gaaaacgaaaagaacaaaaag

SEQ ID NO: 1285 - DNA, 21 bp, Nilaparvata lugens
tgccaagcctaaagatttggg

SEQ ID NO: 1286 - DNA, 26 bp, Nilaparvata lugens
atgttcaagaaagttaatgctagaga

SEQ ID NO: 1287 - DNA, 25 bp, Nilaparvata lugens
gagttgttggtgttcttttgggatg

SEQ ID NO: 1288 - DNA, 22 bp, Nilaparvata lugens
tttcaaacagttttgcagttcc

SEQ ID NO: 1289 - DNA, 25 bp, Nilaparvata lugens
gagttgttggtgttcttttgggatg

SEQ ID NO: 1290 - DNA, 21 bp, Nilaparvata lugens
aaggacctgactgccaagcag

SEQ ID NO: 1291 - DNA, 21 bp, Nilaparvata lugens
gccaagcagatccaggacatg

SEQ ID NO: 1292 - DNA, 23 bp, Nilaparvata lugens
tgctcgaagagctacgtgttccg

SEQ ID NO: 1293 - DNA, 21 bp, Nilaparvata lugens
aagagctacgtgttccgtggc

SEQ ID NO: 1294 - DNA, 21 bp, Nilaparvata lugens
aaggacctgactgccaagcag

SEQ ID NO: 1295 - DNA, 26 bp, Nilaparvata lugens
atggacacatttttccaaattctcat

SEQ ID NO: 1296 - DNA, 22 bp, Nilaparvata lugens
accagcagtattcaacccgaca

SEQ ID NO: 1297 - DNA, 22 bp, Nilaparvata lugens
tattgatggacacatttttcca

SEQ ID NO: 1298 - DNA, 23 bp, Nilaparvata lugens
ttcaacaacagtcctgatgaaac

SEQ ID NO: 1299 - DNA, 21 bp, Nilaparvata lugens
atggacacatttttccaaatt

SEQ ID NO: 1300 - DNA, 23 bp, Nilaparvata lugens
ccgcagttcatgtaccatctgcg

SEQ ID NO: 1301 - DNA, 21 bp, Nilaparvata lugens
atggacacatttttccaaatt

SEQ ID NO: 1302 - DNA, 23 bp, Nilaparvata lugens
aagaagtatgttgccacccttgg

SEQ ID NO: 1303 - DNA, 38 bp, Nilaparvata lugens
gacatcaaggacaggaaagtcaaggccaagagcatagt

SEQ ID NO: 1304 - DNA, 31 bp, Nilaparvata lugens
caactacaacttcgagaagccgttcctgtgg

SEQ ID NO: 1305 - DNA, 23 bp, Nilaparvata lugens
tacaagaacgttcccaactggca

SEQ ID NO: 1306 - DNA, 23 bp, Nilaparvata lugens
tgcgaaaacattcccattgtact

SEQ ID NO: 1307 - DNA, 26 bp, Nilaparvata lugens
aggaagaagaaccttcagtactacga

SEQ ID NO: 1308 - DNA, 23 bp, Nilaparvata lugens
agcaactacaacttcgagaagcc

SEQ ID NO: 1309 - DNA, 32 bp, Nilaparvata lugens
aacaaagtagacatcaaggacaggaaagtcaa

SEQ ID NO: 1310 - DNA, 24 bp, Nilaparvata lugens
cccaactggcacagagatttagtg

SEQ ID NO: 1311 - DNA, 23 bp, Nilaparvata lugens
gatggtggtaccggcaaaactac

SEQ ID NO: 1312 - DNA, 24 bp, Nilaparvata lugens
tacaagaacgttcccaactggcac

SEQ ID NO: 1313 - DNA, 32 bp, Nilaparvata lugens; identical to SEQ ID NO: 1309

SEQ ID NO: 1314 - DNA, 23 bp, Nilaparvata lugens
ttgactttcctgtccttgatgtc

SEQ ID NO: 1315 - DNA, 26 bp, Nilaparvata lugens
gacatcaaggacaggaaagtcaaggc

SEQ ID NO: 1316 - DNA, 26 bp, Nilaparvata lugens
aggaagaagaaccttcagtactacga

SEQ ID NO: 1317 - DNA, 24 bp, Nilaparvata lugens
gatgtcgtagtactgaaggttctt

SEQ ID NO: 1318 - DNA, 31 bp, Nilaparvata lugens; identical to SEQ ID NO: 1304

SEQ ID NO: 1319 - DNA, 25 bp, Nilaparvata lugens
ccaacctggagttcgtcgccatgcc

SEQ ID NO: 1320 - DNA, 23 bp, Nilaparvata lugens
gaatttgaaaagaagtatgttgc

SEQ ID NO: 1321 - DNA, 26 bp, Nilaparvata lugens
cttcagtactacgacatcagtgcgaa

SEQ ID NO: 1322 - DNA, 23 bp, Nilaparvata lugens
agcaactacaacttcgagaagcc

SEQ ID NO: 1323 - DNA, 29 bp, Nilaparvata lugens
aagctgatcggtgaccccaacctggagtt

SEQ ID NO: 1324 - DNA, 22 bp, Nilaparvata lugens
cacagtttgaacagcaagctgg

SEQ ID NO: 1325 - DNA, 24 bp, Nilaparvata lugens
gcagcagacgcaggcacaggtaga

SEQ ID NO: 1326 - DNA, 22 bp, Nilaparvata lugens
cacagtttgaacagcaagctgg

SEQ ID NO: 1327 - DNA, 23 bp, Nilaparvata lugens
caagcgaagatgttggacatgct

SEQ ID NO: 1328 - DNA, 29 bp, Nilaparvata lugens
atggtggtgggctggtaccactcgcaccc

SEQ ID NO: 1329 - DNA, 26 bp, Nilaparvata lugens
gtggtgggctggtaccactcgcaccc

SEQ ID NO: 1330 - DNA, 23 bp, Nilaparvata lugens
gtgggctggtaccactcgcaccc

SEQ ID NO: 1331 - DNA, 29 bp, Nilaparvata lugens
aagatgttggacatgctaaagcagacagg

SEQ ID NO: 1332 - DNA, 22 bp, Nilaparvata lugens
tgtcgggtgtcgacatcaacac

SEQ ID NO: 1333 - DNA, 21 bp, Nilaparvata lugens
gttcccatggaagttatgggc

SEQ ID NO: 1334 - DNA, 23 bp, Nilaparvata lugens
gtgggctggtaccactcgcaccc

SEQ ID NO: 1335 - DNA, 23 bp, Nilaparvata lugens
gagatcgatgccaaggccgagga

SEQ ID NO: 1336 - DNA, 21 bp, Nilaparvata lugens
gaattcaacattgaaaaggga

SEQ ID NO: 1337 - DNA, 23 bp, Nilaparvata lugens
gaagaattcaacattgaaaaggg

SEQ ID NO: 1338 - DNA, 23 bp, Nilaparvata lugens
gaagccaatgagaaagccgaaga

SEQ ID NO: 1339 - DNA, 23 bp, Nilaparvata lugens
tcgtcaaacatgctgaaccaagc

SEQ ID NO: 1340 - DNA, 24 bp, Nilaparvata lugens
tttcattgagcaagaagccaatga

SEQ ID NO: 1341 - DNA, 23 bp, Nilaparvata lugens
caagaagccaatgagaaagccga

SEQ ID NO: 1342 - DNA, 24 bp, Nilaparvata lugens
tttcattgagcaagaagccaatga

SEQ ID NO: 1343 - DNA, 21 bp, Nilaparvata lugens
agaagccaatgagaaagccga

SEQ ID NO: 1344 - DNA, 23 bp, Nilaparvata lugens
tcgtcaaacatgctgaaccaagc

SEQ ID NO: 1345 - DNA, 32 bp, Nilaparvata lugens
gccaatgagaaagccgaagagatcgatgccaa

SEQ ID NO: 1346 - DNA, 23 bp, Nilaparvata lugens
aaagccgaagagatcgatgccaa

SEQ ID NO: 1347 - DNA, 23 bp, Nilaparvata lugens
gagatcgatgccaaggccgagga

SEQ ID NO: 1348 - DNA, 23 bp, Nilaparvata lugens
gaagaattcaacattgaaaaggg

SEQ ID NO: 1349 - DNA, 29 bp, Nilaparvata lugens
gaagaattcaacattgaaaagggaaggct

SEQ ID NO: 1350 - DNA, 22 bp, Nilaparvata lugens
aagaattcaacattgaaaaggg

SEQ ID NO: 1351 - DNA, 23 bp, Nilaparvata lugens
gaggtgctgcgcatccacaccaa

SEQ ID NO: 1352 - DNA, 23 bp, Nilaparvata lugens
atccatgtgctgcccattgatga

SEQ ID NO: 1353 - DNA, 21 bp, Nilaparvata lugens
catgtgctgcccattgatgat

SEQ ID NO: 1354 - DNA, 31 bp, Nilaparvata lugens
ctgcgcatccacaccaagaacatgaagttgg

SEQ ID NO: 1355 - DNA, 23 bp, Nilaparvata lugens
ttcttcttcctcatcaacggacc

SEQ ID NO: 1356 - DNA, 21 bp, Nilaparvata lugens
gagatggtggagttgccgctg

SEQ ID NO: 1357 - DNA, 21 bp, Nilaparvata lugens
cagatcaaagagatggtggag

SEQ ID NO: 1358 - DNA, 21 bp, Nilaparvata lugens
atcaacggacccgagattatg

SEQ ID NO: 1359 - DNA, 23 bp, Nilaparvata lugens
atgaagatgatggccggtgcgtt

SEQ ID NO: 1360 - DNA, 24 bp, Nilaparvata lugens
ccggccatcatcttcatcgatgag

SEQ ID NO: 1361 - DNA, 26 bp, Nilaparvata lugens
atcatcttcatcgatgagctggacgc

SEQ ID NO: 1362 - DNA, 23 bp, Nilaparvata lugens
cagctgctgacgctgatggacgg

SEQ ID NO: 1363 - DNA, 29 bp, Nilaparvata lugens
atcgacattggcattcccgatgccaccgg

SEQ ID NO: 1364 - DNA, 30 bp, Nilaparvata lugens
tctatggagaacgtgtgcctgttcttgaac

SEQ ID NO: 1365 - DNA, 23 bp, Nilaparvata lugens
taccagtgcgagaagcacgtgct

SEQ ID NO: 1366 - DNA, 32 bp, Nilaparvata lugens
atggagaacgtgtgcctgttcttgaacctggc

SEQ ID NO: 1367 - DNA, 23 bp, Nilaparvata lugens
cgtggccagaaaatccccatctt

SEQ ID NO: 1368 - DNA, 26 bp, Nilaparvata lugens
tggcctaccagtgcgagaagcacgtg

SEQ ID NO: 1369 - DNA, 25 bp, Nilaparvata lugens
tggccaccatctacgagcgcgccgg

SEQ ID NO: 1370 - DNA, 26 bp, Nilaparvata lugens
atggagaacgtgtgcctgttcttgaa

SEQ ID NO: 1371 - DNA, 23 bp, Nilaparvata lugens
cccgaggaaatgatccagactgg

SEQ ID NO: 1372 - DNA, 28 bp, Nilaparvata lugens
tggcctaccagtgcgagaagcacgtgct

SEQ ID NO: 1373 - DNA, 48 bp, Nilaparvata lugens
gaggaggtgcccggccgtcgtggtttccccggttacatgtacaccgat

SEQ ID NO: 1374 - DNA, 23 bp, Nilaparvata lugens
gagggtcgcaacggctccatcac

SEQ ID NO: 1375 - DNA, 45 bp, Nilaparvata lugens
gaggtgcccggccgtcgtggtttccccggttacatgtacaccgat

SEQ ID NO: 1376 - DNA, 27 bp, Nilaparvata lugens
atggagaacgtgtgcctgttcttgaac

SEQ ID NO: 1377 - DNA, 37 bp, Nilaparvata lugens
tggcctaccagtgcgagaagcacgtgctcgtcatcct

SEQ ID NO: 1378 - DNA, 33 bp, Nilaparvata lugens
cgtcgtggtttccccggttacatgtacaccgat

SEQ ID NO: 1379 - DNA, 35 bp, Nilaparvata lugens
tggtcgcgtatctatcccgaggaaatgatccagac

SEQ ID NO: 1380 - DNA, 38 bp, Nilaparvata lugens
tggtcgcgtatctatcccgaggaaatgatccagactgg

SEQ ID NO: 1381 - DNA, 30 bp, Nilaparvata lugens; identical to SEQ ID NO: 1364

SEQ ID NO: 1382 - DNA, 27 bp, Nilaparvata lugens
atggagaacgtgtgcctgttcttgaac

SEQ ID NO: 1383 - DNA, 21 bp, Nilaparvata lugens
aacgtgtgcctgttcttgaac

SEQ ID NO: 1384 - DNA, 28 bp, Nilaparvata lugens
tggcctaccagtgcgagaagcacgtgct

SEQ ID NO: 1385 - DNA, 37 bp, Nilaparvata lugens; identical to SEQ ID NO: 1377

SEQ ID NO: 1386 - DNA, 26 bp, Nilaparvata lugens
gcctaccagtgcgagaagcacgtgct

SEQ ID NO: 1387 - DNA, 44 bp, Nilaparvata lugens
gaggaggtgcccggccgtcgtggtttccccggttacatgtacac

SEQ ID NO: 1388 - DNA, 48 bp, Nilaparvata lugens; identical to SEQ ID NO: 1373

SEQ ID NO: 1389 - DNA, 45 bp, Nilaparvata lugens; identical to SEQ ID NO: 1375

SEQ ID NO: 1390 - DNA, 23 bp, Nilaparvata lugens
cgtcgtggtttccccggttacat

SEQ ID NO: 1391 - DNA, 33 bp, Nilaparvata lugens; identical to SEQ ID NO: 1378

SEQ ID NO: 1392 - DNA, 30 bp, Nilaparvata lugens
cgtggtttccccggttacatgtacaccgat

SEQ ID NO: 1393 - DNA, 28 bp, Nilaparvata lugens
atcggtgtacatgtaaccggggaaacca

SEQ ID NO: 1394 - DNA, 23 bp, Nilaparvata lugens
cgtccggcgcgctcgtagatggt

SEQ ID NO: 1395 - DNA, 23 bp, Nilaparvata lugens
gagggtcgcaacggctccatcac

SEQ ID NO: 1396 - DNA, 21 bp, Nilaparvata lugens
cggacgtggcctggttcatca

SEQ ID NO: 1397 - DNA, 39 bp, Nilaparvata lugens
gtggtgtacgactgcaccgaccaggagtcgttcaacaac

SEQ ID NO: 1398 - DNA, 26 bp, Nilaparvata lugens
gaaagttacatcagtaccattggtgt

SEQ ID NO: 1399 - DNA, 25 bp, Nilaparvata lugens
caccgaccaggagtcgttcaacaac

SEQ ID NO: 1400 - DNA, 26 bp, Nilaparvata lugens
agtaccattggtgtagattttaaaat

SEQ ID NO: 1401 - DNA, 23 bp, Nilaparvata lugens
attggtgtagattttaaaattag

SEQ ID NO: 1402 - DNA, 23 bp, Nilaparvata lugens
ggtgtagattttaaaattagaac

SEQ ID NO: 1403 - DNA, 26 bp, Nilaparvata lugens
ggtgtagattttaaaattagaacaat

SEQ ID NO: 1404 - DNA, 22 bp, Nilaparvata lugens
gttctaattttaaaatctacac

SEQ ID NO: 1405 - DNA, 21 bp, Nilaparvata lugens
tgggacacggccggccaggag

SEQ ID NO: 1406 - DNA, 23 bp, Nilaparvata lugens
tgggacacggccggccaggagcg

SEQ ID NO: 1407 - DNA, 25 bp, Nilaparvata lugens
tgggacacggccggccaggagcggt

SEQ ID NO: 1408 - DNA, 23 bp, Nilaparvata lugens
gaccagctgggcattccgttcct

SEQ ID NO: 1409 - DNA, 21 bp, Nilaparvata lugens
attggtgtagattttaaaatt

SEQ ID NO: 1410 - DNA, 26 bp, Nilaparvata lugens
tgggacacggccggccaggagcggtt

SEQ ID NO: 1411 - DNA, 23 bp, Nilaparvata lugens
caggagcggttccgcacgatcac

SEQ ID NO: 1412 - DNA, 26 bp, Nilaparvata lugens
attggtgtagattttaaaattagaac

SEQ ID NO: 1413 - DNA, 23 bp, Nilaparvata lugens
attggtgtagattttaaaattag

SEQ ID NO: 1414 - DNA, 21 bp, Nilaparvata lugens
tgggacacggccggccaggag

SEQ ID NO: 1415 - DNA, 25 bp, Nilaparvata lugens
tgggacacggccggccaggagcggt

SEQ ID NO: 1416 - DNA, 32 bp, Nilaparvata lugens
gatgacacatacacagaaagttacatcagtac

SEQ ID NO: 1417 - DNA, 23 bp, Nilaparvata lugens
acggccggccaggagcggttccg

SEQ ID NO: 1418 - DNA, 26 bp, Nilaparvata lugens
agtaccattggtgtagattttaaaat

SEQ ID NO: 1419 - DNA, 22 bp, Nilaparvata lugens
taaagcttcagatttgggacac

SEQ ID NO: 1420 - DNA, 23 bp, Nilaparvata lugens
atttgggacacggccggccagga

SEQ ID NO: 1421 - DNA, 39 bp, Nilaparvata lugens; identical to SEQ ID NO: 1397

SEQ ID NO: 1422 - DNA, 26 bp, Nilaparvata lugens
ggtgtagattttaaaattagaacaat

SEQ ID NO: 1423 - DNA, 23 bp, Nilaparvata lugens
tgggacacggccggccaggagcg

SEQ ID NO: 1424 - DNA, 25 bp, Nilaparvata lugens
tcttcctcaccggtcaggaggagat

SEQ ID NO: 1425 - DNA, 26 bp, Nilaparvata lugens
aaattctccgagtttttcgacgatgc

SEQ ID NO: 1426 - DNA, 23 bp, Nilaparvata lugens
ttcctcaccggtcaggaggagat

SEQ ID NO: 1427 - DNA, 25 bp, Nilaparvata lugens
tagtattggccacaaatattgcaga

SEQ ID NO: 1428 - DNA, 23 bp, Nilaparvata lugens
tatttgaacatatgggtgccgca

SEQ ID NO: 1429 - DNA, 23 bp, Nilaparvata lugens
gagggagaggaaatgtggaatcc

SEQ ID NO: 1430 - DNA, 22 bp, Nilaparvata lugens
ccgaagattgtctgtatttgaa

SEQ ID NO: 1431 - DNA, 21 bp, Nilaparvata lugens
gattccgtttgcgaaacctcc

SEQ ID NO: 1432 - DNA, 23 bp, Nilaparvata lugens
ggtgcgttcggcttcctctacct

SEQ ID NO: 1433 - DNA, 21 bp, Nilaparvata lugens
caattcaatgctagggaaagg

SEQ ID NO: 1434 - DNA, 23 bp, Nilaparvata lugens
gagggagaggaaatgtggaatcc

SEQ ID NO: 1435 - DNA, 22 bp, Nilaparvata lugens
ccgaagattgtctgtatttgaa

SEQ ID NO: 1436 - DNA, 23 bp, Nilaparvata lugens
gacgtcatcgtcgcctccatgca

SEQ ID NO: 1437 - DNA, 21 bp, Nilaparvata lugens
ggagaccctggagctggtgcg

SEQ ID NO: 1438 - DNA, 24 bp, Nilaparvata lugens
agtacaagctgtgcaaagtgaaga

SEQ ID NO: 1439 - DNA, 24 bp, Nilaparvata lugens
atggatgttggacaaattgggtgg

SEQ ID NO: 1440 - DNA, 23 bp, Nilaparvata lugens
tggatgttggacaaattgggtgg

SEQ ID NO: 1441 - DNA, 24 bp, Nilaparvata lugens
agtacaagctgtgcaaagtgaaga

SEQ ID NO: 1442 - DNA, 22 bp, Nilaparvata lugens
agtccatccatcacgcccgtgt

SEQ ID NO: 1443 - DNA, 24 bp, Nilaparvata lugens
ctccgtaacaagcgtgaggtgtgg

SEQ ID NO: 1444 - DNA, 26 bp, Nilaparvata lugens
gactcgcagaagcacattgacttctc

SEQ ID NO: 1445 - DNA, 21 bp, Nilaparvata lugens
gcagaagcacattgacttctc

SEQ ID NO: 1446 - DNA, 22 bp, Nilaparvata lugens
gccaagtccatccatcacgccc

SEQ ID NO: 1447 - DNA, 26 bp, Nilaparvata lugens
gccaagtccatccatcacgcccgtgt

SEQ ID NO: 1448 - DNA, 23 bp, Nilaparvata lugens
tcgcagaagcacattgacttctc

SEQ ID NO: 1449 - DNA, 29 bp, Nilaparvata lugens
tcgcagaagcacattgacttctcgctgaa

SEQ ID NO: 1450 - DNA, 26 bp, Nilaparvata lugens
gccaagtccatccatcacgcccgtgt

SEQ ID NO: 1451 - DNA, 26 bp, Nilaparvata lugens
gactcgcagaagcacattgacttctc

SEQ ID NO: 1452 - DNA, 24 bp, Nilaparvata lugens
ctccgtaacaagcgtgaggtgtgg

SEQ ID NO: 1453 - DNA, 23 bp, Nilaparvata lugens
aagaacaaggatattcgtaaatt

SEQ ID NO: 1454 - DNA, 29 bp, Nilaparvata lugens
aagaacaaggatattcgtaaattcttgga

SEQ ID NO: 1455 - DNA, 26 bp, Nilaparvata lugens
ccgtgtacgcccatttccccatcaac

SEQ ID NO: 1456 - DNA, 21 bp, Nilaparvata lugens
tacgcccatttccccatcaac

SEQ ID NO: 1457 - DNA, 23 bp, Nilaparvata lugens
caacatgaatgcattcctcaagc

SEQ ID NO: 1458 - DNA, 23 bp, Nilaparvata lugens
gaagtacaacatgaatgcattcc

SEQ ID NO: 1459 - DNA, 21 bp, Nilaparvata lugens
gctgtatttgtgttggcgaca

SEQ ID NO: 1460 - DNA, 21 bp, Nilaparvata lugens
agaaaaggttgtgggttggta

SEQ ID NO: 1461 - DNA, 35 bp, Nilaparvata lugens
ggacttcgtgatggatattacattcagggacaatg

SEQ ID NO: 1462 - DNA, 21 bp, Nilaparvata lugens
caactacaacttcgagaagcc

SEQ ID NO: 1463 - DNA, 23 bp, Nilaparvata lugens
gaagaattcaacattgaaaaggg

SEQ ID NO: 1464 - DNA, 23 bp, Nilaparvata lugens
gagcaagaagccaatgagaaagc

SEQ ID NO: 1465 - DNA, 36 bp, Nilaparvata lugens
tttcattgagcaagaagccaatgagaaagccgaaga

SEQ ID NO: 1466 - DNA, 27 bp, Nilaparvata lugens
atgagcaaattggccggcgagtcggag

SEQ ID NO: 1467 - DNA, 26 bp, Nilaparvata lugens
cacaccaagaacatgaagttggctga

SEQ ID NO: 1468 - DNA, 21 bp, Nilaparvata lugens
caggaaatctgttcgaagtgt

SEQ ID NO: 1469 - DNA, 23 bp, Nilaparvata lugens
ctggcgcagatcaaagagatggt

SEQ ID NO: 1470 - DNA, 22 bp, Nilaparvata lugens
tggcgcagatcaaagagatggt

SEQ ID NO: 1471 - DNA, 23 bp, Nilaparvata lugens
tatcccgaggaaatgatccagac

SEQ ID NO: 1472 - DNA, 38 bp, Nilaparvata lugens
cgtatctatcccgaggaaatgatccagactggaatttc

SEQ ID NO: 1473 - DNA, 21 bp, Nilaparvata lugens
tggatgggagtcatgcatgga

SEQ ID NO: 1474 - DNA, 24 bp, Nilaparvata lugens
ccaagggcaagggtgtgaagctca

SEQ ID NO: 1475 - DNA, 23 bp, Nilaparvata lugens
tctctgcccaagggcaagggtgt

SEQ ID NO: 1476 - DNA, 21 bp, Nilaparvata lugens
tctgcccaagggcaagggtgt

SEQ ID NO: 1477 - DNA, 21 bp, Nilaparvata lugens
tctctgcccaagggcaagggt

SEQ ID NO: 1478 - DNA, 23 bp, Nilaparvata lugens
tctctgcccaagggcaagggtgt

SEQ ID NO: 1479 - DNA, 24 bp, Nilaparvata lugens
ctgcccaagggcaagggtgtgaag

SEQ ID NO: 1480 - DNA, 22 bp, Nilaparvata lugens
atgaagctcgattacgtcttgg

SEQ ID NO: 1481 - DNA, 21 bp, Nilaparvata lugens
cgtaaggccgctcgtgagctg

SEQ ID NO: 1482 - DNA, 26 bp, Nilaparvata lugens
cgtaaggccgctcgtgagctgttgac

SEQ ID NO: 1483 - DNA, 23 bp, Nilaparvata lugens
gactcgcagaagcacattgactt

SEQ ID NO: 1484 - DNA, 21 bp, Nilaparvata lugens
tgaagctcgattacgtcttgg

SEQ ID NO: 1485 - DNA, 28 bp, Nilaparvata lugens
tggccaagtccatccatcacgcccgtgt

SEQ ID NO: 1486 - DNA, 21 bp, Nilaparvata lugens
cgtaacttcctgggcgagaag

SEQ ID NO: 1487 - DNA, 22 bp, Nilaparvata lugens
atgaagctcgattacgtcttgg

SEQ ID NO: 1488 - DNA, 22 bp, Nilaparvata lugens
tcggtttggccaagtccatcca

SEQ ID NO: 1489 - DNA, 23 bp, Nilaparvata lugens
gactcgcagaagcacattgactt

SEQ ID NO: 1490 - DNA, 26 bp, Nilaparvata lugens
gactcgcagaagcacattgacttctc

SEQ ID NO: 1491 - DNA, 21 bp, Nilaparvata lugens
tacgcccatttccccatcaac

SEQ ID NO: 1492 - DNA, 25 bp, Nilaparvata lugens
cgtgtacgcccatttccccatcaac

SEQ ID NO: 1493 - DNA, 21 bp, Nilaparvata lugens
tacgcccatttccccatcaac

SEQ ID NO: 1494 - DNA, 23 bp, Nilaparvata lugens
tacgcccatttccccatcaactg

SEQ ID NO: 1495 - DNA, 25 bp, Nilaparvata lugens
cgtgtacgcccatttccccatcaac

SEQ ID NO: 1496 - DNA, 21 bp, Nilaparvata lugens
aaaaggtcaaggaggccaaga

SEQ ID NO: 1497 - DNA, 26 bp, Nilaparvata lugens
ttcaagaacaagcgtgtattgatgga

SEQ ID NO: 1498 - DNA, 28 bp, Nilaparvata lugens
ttcaagaacaagcgtgtattgatggagt

SEQ ID NO: 1499 - DNA, 21 bp, Nilaparvata lugens
cctggaggaggagacgaccat

SEQ ID NO: 1500 - DNA, 22 bp, Nilaparvata lugens
tcccatctcgtatgacaattgg

SEQ ID NO: 1501 - DNA, 21 bp, Nilaparvata lugens
atggtcgtctcctcctccagg

SEQ ID NO: 1502 - DNA, 22 bp, Nilaparvata lugens
tcccatctcgtatgacaattgg

SEQ ID NO: 1503 - DNA, 23 bp, Nilaparvata lugens
caagtcatgatgttcagtgcaac

SEQ ID NO: 1504 - DNA, 23 bp, Nilaparvata lugens
tgacgcttcacggcctgcagcag

SEQ ID NO: 1505 - DNA, 23 bp, Nilaparvata lugens
caagtcatgatgttcagtgcaac

SEQ ID NO: 1506 - DNA, 23 bp, Nilaparvata lugens
caattcttgcaagtgttcaacaa

SEQ ID NO: 1507 - DNA, 23 bp, Nilaparvata lugens
ttcaacaacagtcctgatgaaac

SEQ ID NO: 1508 - DNA, 21 bp, Nilaparvata lugens
ttcttgcaagtgttcaacaac

SEQ ID NO: 1509 - DNA, 21 bp, Nilaparvata lugens
aagaacgttcccaactggcac

SEQ ID NO: 1510 - DNA, 22 bp, Nilaparvata lugens
acaagaacgttcccaactggca

SEQ ID NO: 1511 - DNA, 22 bp, Nilaparvata lugens
acctacaagaacgttcccaact

SEQ ID NO: 1512 - DNA, 27 bp, Nilaparvata lugens
acctacaagaacgttcccaactggcac

SEQ ID NO: 1513 - DNA, 21 bp, Nilaparvata lugens
caactacaacttcgagaagcc

SEQ ID NO: 1514 - DNA, 22 bp, Nilaparvata lugens
caagaacgttcccaactggcac

SEQ ID NO: 1515 - DNA, 22 bp, Nilaparvata lugens
cacctacaagaacgttcccaac

SEQ ID NO: 1516 - DNA, 22 bp, Nilaparvata lugens
cctacaagaacgttcccaactg

SEQ ID NO: 1517 - DNA, 22 bp, Nilaparvata lugens
ctacaagaacgttcccaactgg

SEQ ID NO: 1518 - DNA, 22 bp, Nilaparvata lugens
gcaactacaacttcgagaagcc

SEQ ID NO: 1519 - DNA, 22 bp, Nilaparvata lugens
tacaagaacgttcccaactggc

SEQ ID NO: 1520 - DNA, 21 bp, Nilaparvata lugens
tcacctacaagaacgttccca

SEQ ID NO: 1521 - DNA, 22 bp, Nilaparvata lugens
tcacctacaagaacgttcccaa

SEQ ID NO: 1522 - DNA, 24 bp, Nilaparvata lugens
tcacctacaagaacgttcccaact

SEQ ID NO: 1523 - DNA, 29 bp, Nilaparvata lugens
tcacctacaagaacgttcccaactggcac

SEQ ID NO: 1524 - DNA, 22 bp, Nilaparvata lugens
tgggacacagctggccaggaaa

SEQ ID NO: 1525 - DNA, 21 bp, Nilaparvata lugens
ttcgagaagccgttcctgtgg

SEQ ID NO: 1526 - DNA, 26 bp, Nilaparvata lugens
ttcgagaagccgttcctgtggttggc

SEQ ID NO: 1527 - DNA, 22 bp, Nilaparvata lugens
tgggacacagctggccaggaaa

SEQ ID NO: 1528 - DNA, 22 bp, Nilaparvata lugens
tattacattcagggacaatgcg

SEQ ID NO: 1529 - DNA, 29 bp, Nilaparvata lugens
tcacctacaagaacgttcccaactggcac

SEQ ID NO: 1530 - DNA, 27 bp, Nilaparvata lugens
acctacaagaacgttcccaactggcac

SEQ ID NO: 1531 - DNA, 23 bp, Nilaparvata lugens
tacaagaacgttcccaactggca

SEQ ID NO: 1532 - DNA, 24 bp, Nilaparvata lugens
tacaagaacgttcccaactggcac

SEQ ID NO: 1533 - DNA, 22 bp, Nilaparvata lugens
aggaagaagaaccttcagtact

SEQ ID NO: 1534 - DNA, 23 bp, Nilaparvata lugens
aagaagaaccttcagtactacga

SEQ ID NO: 1535 - DNA, 27 bp, Nilaparvata lugens
aagaagaaccttcagtactacgacatc

SEQ ID NO: 1536 - DNA, 24 bp, Nilaparvata lugens
aagaaccttcagtactacgacatc

SEQ ID NO: 1537 - DNA, 22 bp, Nilaparvata lugens
ggcttctcgaagttgtagttgc

SEQ ID NO: 1538 - DNA, 21 bp, Nilaparvata lugens
caactacaacttcgagaagcc

SEQ ID NO: 1539 - DNA, 21 bp, Nilaparvata lugens
ggcttctcgaagttgtagttg

SEQ ID NO: 1540 - DNA, 26 bp, Nilaparvata lugens
cccgagatggtggtgggctggtacca

SEQ ID NO: 1541 - DNA, 22 bp, Nilaparvata lugens
ggtaccactcgcacccgggctt

SEQ ID NO: 1542 - DNA, 47 bp, Nilaparvata lugens
gtgggctggtaccactcgcacccgggcttcggctgctggctgtcggg

SEQ ID NO: 1543 - DNA, 23 bp, Nilaparvata lugens
tggtaccactcgcacccgggctt

SEQ ID NO: 1544 - DNA, 26 bp, Nilaparvata lugens
cccgagatggtggtgggctggtacca

SEQ ID NO: 1545 - DNA, 21 bp, Nilaparvata lugens
atccacaccaagaacatgaag

SEQ ID NO: 1546 - DNA, 22 bp, Nilaparvata lugens
cacaccaagaacatgaagttgg

SEQ ID NO: 1547 - DNA, 23 bp, Nilaparvata lugens
gccttcttcttcctcatcaacgg

SEQ ID NO: 1548 - DNA, 22 bp, Nilaparvata lugens
ttggaggctgcagaaagcagct

SEQ ID NO: 1549 - DNA, 23 bp, Nilaparvata lugens
gccttcttcttcctcatcaacgg

SEQ ID NO: 1550 - DNA, 21 bp, Nilaparvata lugens
atccacaccaagaacatgaag

SEQ ID NO: 1551 - DNA, 23 bp, Nilaparvata lugens
cacaccaagaacatgaagttggc

SEQ ID NO: 1552 - DNA, 21 bp, Nilaparvata lugens
catgaactcgattgctcgtgg

SEQ ID NO: 1553 - DNA, 25 bp, Nilaparvata lugens
ccaccatctacgagcgcgccggacg

SEQ ID NO: 1554 - DNA, 21 bp, Nilaparvata lugens
catgaactcgattgctcgtgg

SEQ ID NO: 1555 - DNA, 21 bp, Nilaparvata lugens
catgtcggtgaggatgacgag

SEQ ID NO: 1556 - DNA, 25 bp, Nilaparvata lugens
ccaccatctacgagcgcgccggacg

SEQ ID NO: 1557 - DNA, 29 bp, Nilaparvata lugens
cagatttgggacacggccggccaggagcg

SEQ ID NO: 1558 - DNA, 21 bp, Nilaparvata lugens
gaccaggagtcgttcaacaac

SEQ ID NO: 1559 - DNA, 21 bp, Nilaparvata lugens
tgggacacggccggccaggag

SEQ ID NO: 1560 - DNA, 23 bp, Nilaparvata lugens
tgggacacggccggccaggagcg

SEQ ID NO: 1561 - DNA, 26 bp, Nilaparvata lugens
tgggacacggccggccaggagcggtt

SEQ ID NO: 1562 - DNA, 26 bp, Nilaparvata lugens
ttcctggagacgtcggcgaagaacgc

SEQ ID NO: 1563 - DNA, 29 bp, Nilaparvata lugens
cagatttgggacacggccggccaggagcg

SEQ ID NO: 1564 - DNA, 21 bp, Nilaparvata lugens
tgggacacggccggccaggag

SEQ ID NO: 1565 - DNA, 23 bp, Nilaparvata lugens
tgggacacggccggccaggagcg

SEQ ID NO: 1566 - DNA, 26 bp, Nilaparvata lugens
tgggacacggccggccaggagcggtt

SEQ ID NO: 1567 - DNA, 29 bp, Nilaparvata lugens
tgggacacggccggccaggagcggttccg

SEQ ID NO: 1568 - DNA, 22 bp, Nilaparvata lugens
caggcaaagattttcctgccca

SEQ ID NO: 1569 - DNA, 23 bp, Nilaparvata lugens
ggcaagtgcttccgtctgtacac

SEQ ID NO: 1570 - DNA, 21 bp, Nilaparvata lugens
ggatgaccaaaaacgtattct

SEQ ID NO: 1571 - DNA, 21 bp, Nilaparvata lugens
agaatacgtttttggtcatcc

SEQ ID NO: 1572 - DNA, 697 bp, Nilaparvata lugens
gaaatcatggatgttggacaaattgggtggtgtgtatgcaccccgacccagcacaggtccacacaagctgcgagaatctctcccacttgtcatatttttgcgtaatcggctcaagtacgctttaactaactgtgaagtgaagaaaattgtgatgcagcgtctcatcaaggttgacggcaaagtgaggactgaccccaactatcctgcaggttttatggacgttgttcaaatcgaaaagacaaacgagttcttccgtttgatctatgatgttaagggacgtttcaccatccacaggatcacagctgaagaagctaagtacaagctgtgcaaagtgaagagggttcagacaggacccaagggcattccatttttgaccactcacgatggacgcaccatcaggtatccagaccccttagtaaaagtcaatgacaccatccaattggacattgccacatccaaaatcatggacttcatcagattcgactctggtaacctgtgtatgatcactggaggtcgtaacttgggtcgtgtgggcactgtcgtgaacagggagcgacacccggggtctttcgacatcgtgcacatcaaggacgtgttgggacacacttttgccactaggttgaacaacgttttcatcatcggcaagggtagtaaagcatacgtgtctctgcccaagggcaagggtgtgaagctcagt

SEQ ID NO: 1573 - DNA, 48 bp, Artificial sequence
  Primer sequence
gcgtaatacgactcactatagggaaatcatggatgttggacaaattgg

SEQ ID NO: 1574 - DNA, 22 bp, Artificial sequence
  Primer sequence
actgagcttcacacccttgccc

SEQ ID NO: 1575 - DNA, 26 bp, Artificial sequence
  Primer sequence
gaaatcatggatgttggacaaattgg

SEQ ID NO: 1576 - DNA, 44 bp, Artificial sequence
  Primer sequence
gcgtaatacgactcactataggactgagcttcacacccttgccc

SEQ ID NO: 1577 - DNA, 336 bp, Nilaparvata lugens; identical to SEQ ID NO: 1073

SEQ ID NO: 1578 - DNA, 46 bp, Artificial sequence
  Primer sequence
gcgtaatacgactcactatagggatgaaaagggccctacaactggc

SEQ ID NO: 1579 - DNA, 26 bp, Artificial sequence
  Primer sequence
ctgatccacatccatgtgttgatgag

SEQ ID NO: 1580 - DNA, 24 bp, Artificial sequence
  Primer sequence
gatgaaaagggccctacaactggc

SEQ ID NO: 1581 - DNA, 48 bp, Artificial sequence
  Primer sequence
gcgtaatacgactcactataggctgatccacatccatgtgttgatgag

SEQ ID NO: 1582 - DNA, 477 bp, Nilaparvata lugens; identical to SEQ ID NO: 1075

SEQ ID NO: 1583 - DNA, 46 bp, Artificial sequence
  Primer sequence
gcgtaatacgactcactataggtccgcgtcgtccttacgagaaggc

SEQ ID NO: 1584 - DNA, 22 bp, Artificial sequence
  Primer sequence
ttgacgcgaccaggtcggccac

SEQ ID NO: 1585 - DNA, 24 bp, Artificial sequence
  Primer sequence
tccgcgtcgtccttacgagaaggc

SEQ ID NO: 1586 - DNA, 44 bp, Artificial sequence
  Primer sequence
gcgtaatacgactcactataggttgacgcgaccaggtcggccac

SEQ ID NO: 1587 - DNA, 305 bp, Nilaparvata lugens
ggagttggctgctgtaagaactgtctgctctcacatcgaaaacatgctgaagggagtcacaaagggattcctgtacaagatgcgtgccgtgtacgcccatttccccatcaactgtgtgacgaccgagaacaactctgtgatcgaggtgcgtaacttcctgggcgagaagtacatccgacgggtgaggatggcgcccggcgtcactgttaccaactcgacaaagcagaaggacgagctcatcgtcgaaggaaacagcatagaggacgtgtcaagatcagctgccctcatccaacagtcaacaacag

SEQ ID NO: 1588 - DNA, 45 bp, Artificial sequence
  Primer sequence
gcgtaatacgactcactataggggagttggctgctgtaagaactg

SEQ ID NO: 1589 - DNA, 23 bp, Artificial sequence
  Primer sequence
ctgttgttgactgttggatgagg

SEQ ID NO: 1590 - DNA, 23 bp, Artificial sequence
  Primer sequence
ggagttggctgctgtaagaactg

SEQ ID NO: 1591 - DNA, 45 bp, Artificial sequence
  Primer sequence
gcgtaatacgactcactataggctgttgttgactgttggatgagg

SEQ ID NO: 1592 - DNA, 424 bp, Nilaparvata lugens
cgcaaacacaaattcacgtcaaagcatcaggaagctgatcaaagacggtcttatcatcaagaaaccggttgcagtacattcacgtgctcgcgttcgtaaaaacactgaagccaggaggaaaggcagacattgtggctttggtaagaggaaaggtacagccaacgcccgtatgccacaaaaggttctatgggtgaatcgtatgcgtgtcttgagaagactgttgaaaaaatacagacaagataagaaaatcgacaggcatctgtaccatcacctttacatgaaggctaagggtaacgtattcaagaacaagcgtgtattgatggagttcattcataagaagaaggccgagaaagcaagaatgaagatgttgaacgaccaggctgaagctcgcagacaaaaggtcaaggaggccaagaagcgaagg

SEQ ID NO: 1593 - DNA, 47 bp, Artificial sequence
  Primer sequence
gcgtaatacgactcactataggcgcaaacacaaattcacgtcaaagc

SEQ ID NO: 1594 - DNA, 24 bp, Artificial sequence
  Primer sequence
ccttcgcttcttggcctccttgac

SEQ ID NO: 1595 - DNA, 25 bp, Artificial sequence
  Primer sequence
cgcaaacacaaattcacgtcaaagc

SEQ ID NO: 1596 - DNA, 46 bp, Artificial sequence
  Primer sequence
gcgtaatacgactcactataggccttcgcttcttggcctccttgac

SEQ ID NO: 1597 - DNA, 965 bp, Nilaparvata lugens
gtgcttgtgtcaagtggtgtggtggagtacattgacaccctggaggaggagacgaccatgatagcgatgtcgccggatgacctgcgtcaggacaaggagtatgcctactgtaccacctacacgcactgcgagatccacccggccatgatactcggtgtgtgcgcctctattattcccttccccgatcacaaccaaagtcccaggaacacctatcagagcgctatggggaaacaggcgatgggcgtgtacatcaccaacttccacgtgcgaatggacacgctggctcacgtgctgttctacccgcacaagccactggtcaccactcgctccatggagtacctgcgcttcagggagcttcctgccggcatcaactctgtggtcgccatcgcctgctacactggatacaaccaggaggacagtgtcattctcaacgcctccgctgtcgagcgcggattcttcagatcggttttcttccgatcttacaaagatgcagaatcgaagcgtattggcgaccaagaggagcaattcgagaagcccaccagacagacgtgtcagggaatgaggaatgccatttatgacaaattggacgatgatggcatcattgctcccggtctgagagtgtctggtgacgatgtggttattggcaaaaccataacactgcccgataatgatgacgagctggaaggtacaacaaagaggttcacgaagagagatgccagtactttcctgcgtaacagtgagacgggaatcgtcgaccaagtcatgttaaccttgaactctgagggttacaagttctgcaaaattcgagtcaggtctgtgcgtatcccgcagattggcgataagttcgcttcccgacatggccaaaaaggaacgtgtggaatacagtatcgtcaagaggacatgccttttacaagcgagggaatcgcaccggatattattatcaatcctcacgctatcccatctcg

SEQ ID NO: 1598 - DNA, 44 bp, Artificial sequence
  Primer sequence
gcgtaatacgactcactatagggtgcttgtgtcaagtggtgtgg

SEQ ID NO: 1599 - DNA, 20 bp, Artificial sequence
  Primer sequence
cgagatgggatagcgtgagg

SEQ ID NO: 1600 - DNA, 22 bp, Artificial sequence
  Primer sequence
gtgcttgtgtcaagtggtgtgg

SEQ ID NO: 1601 - DNA, 42 bp, Artificial sequence
  Primer sequence
gcgtaatacgactcactataggcgagatgggatagcgtgagg

SEQ ID NO: 1602 - DNA, 790 bp, Nilaparvata lugens
tgagagcaatccttgactgtggttttgaacatccatctgaagtacaacatgaatgcattcctcaagctgtacttggaatggacatattgtgtcaagcgaaatccggtatgggaaaaactgctgtatttgtgttggcgacattacagcaaattgaaccaactgacaaccaagtcagtgtattggtcatgtgtcataccagagagcttgcattccaaatcagcaaagagtatgaacgattttcgaaatgtatgccaaatatcaaggttggagttttcttcggcggactgccgattcagagggatgaggagacgttgaaattgaactgtcctcacatcgtggttggaacacccggacgaattttggcgttggtacgcaacaagaagctggacctcaagcatctcaagcactttgtccttgacgaatgtgacaaaatgttggaactgttagatatgcgaagagatgtgcaggaaatattccgaaacacgccgcacagcaaacaagtcatgatgttcagtgcaactctcagcaaagaaattcgtccagtctgcaagaaattcatgcaagatccgatggaagtgtacgttgatgacgaggccaagctgacgcttcacggcctgcagcagcactatgtcaaactcaaagaaaacgaaaagaacaaaaagttatttgaattacttgacatacttgaattcaaccaggttgttatatttgtgaagtcagtgcagcgctgcatggccctatcgcaactcctaacagagcagaacttccctgcagtggctattcaccgtgg

SEQ ID NO: 1603 - DNA, 44 bp, Artificial sequence
  Primer sequence
gcgtaatacgactcactataggtgagagcaatccttgactgtgg

SEQ ID NO: 1604 - DNA, 20 bp, Artificial sequence
  Primer sequence
ccacggtgaatagccactgc

SEQ ID NO: 1605 - DNA, 22 bp, Artificial sequence
  Primer sequence
tgagagcaatccttgactgtgg

SEQ ID NO: 1606 - DNA, 42 bp, Artificial sequence
  Primer sequence
gcgtaatacgactcactataggccacggtgaatagccactgc

SEQ ID NO: 1607 - DNA, 629 bp, Nilaparvata lugens
gatgctggagacctggaggtgtattagatgtttcaaacagttttgcagttccatttgatgaggacgacaaagaaaagaatgtttggttcttagaccatgattacttggaaaacatgttcgggatgttcaagaaagttaatgctagagaaaaggttgtgggttggtaccatactggacccaaactccaccaaaacgatgttgcaatcaatgagttgattcgtcgttactgtccaaactgtgtcttagtcataatcgatgccaagcctaaagatttgggtctacctacagaggcatacagagtcgttgaagaaatccatgatgatggatcgccaacatcaaaaacatttgaacatgtgatgagtgagattggggcagaagaggctgaggagattggcgttgaacatctgttgagagacatcaaagatacaacagtcgggtcactgtcacagcgcgtcacaaatcagctgatgggcttgaagggcttgcatctgcaattacaggatatgcgagactatttgaatcaggttgtcgaaggaaagttgccaatgaaccatcaaatcgtttaccaactgcaagacatcttcaaccttctacccgatatcggccacggcaattttgtagactcgctc

SEQ ID NO: 1608 - DNA, 43 bp, Artificial sequence
  Primer sequence
gcgtaatacgactcactatagggatgctggagacctggaggtg

SEQ ID NO: 1609 - DNA, 22 bp, Artificial sequence
  Primer sequence
gagcgagtctacaaaattgccg

SEQ ID NO: 1610 - DNA, 21 bp, Artificial sequence
  Primer sequence
gatgctggagacctggaggtg

SEQ ID NO: 1611 - DNA, 44 bp, Artificial sequence
  Primer sequence
gcgtaatacgactcactatagggagcgagtctacaaaattgccg

SEQ ID NO: 1612 - DNA, 355 bp, Nilaparvata lugens
gcgactatgatcgaccgccgggacgcggtcaggtgtgcgacgtcgacgtcaagaactggtttccctgcacctctgagaacaatttcaactaccatcaatcgagcccttgtgtttttctcaaactgaacaagataattggttggcaaccggagtactacaatgagactgaaggctttccagataatatgccaggtgacctcaagcgacacattgcccaacagaagagtatcaacaagctgtttatgcaaacaatctggataacttgcgaaggagagggtcctctagacaaggagaatgcaggggagatccagtacatccctagacagggatttccgggctacttctacccttacac

SEQ ID NO: 1613 - DNA, 41 bp, Artificial sequence
  Primer sequence
gcgtaatacgactcactatagggcgactatgatcgaccgcc

SEQ ID NO: 1614 - DNA, 23 bp, Artificial sequence
  Primer sequence
gtgtaagggtagaagtagcccgg

SEQ ID NO: 1615 - DNA, 19 bp, Artificial sequence
  Primer sequence
gcgactatgatcgaccgcc

SEQ ID NO: 1616 - DNA, 45 bp, Artificial sequence
  Primer sequence
gcgtaatacgactcactatagggtgtaagggtagaagtagcccgg

SEQ ID NO: 1617 - DNA, 711 bp, Nilaparvata lugens
gcttgttgttcccgttggatgtctgtatcaacctttgaaggagagacctgatctaccgcctgtacagtacgatccagttctttgtactaggaatacttgtcgtgcaattctgaatccattgtgccaagtcgactatcgagccaagctatgggtctgcaacttttgtttccagaggaatcctttcccccctcaatatgcagctatttcggagcagcatcaaccagcagaactgataccttcattttccaccatcgaatacatcattaccagagcgcaaacgatgccgccgatgttcgtgctggtggtggacacatgtctggacgacgaggagctgggagctttgaaggactcactgcagatgtcgctgtcgctgctgccgcccaatgcactcatcggtctcatcacgttcggcaaaatggtgcaggtgcacgagcttggctgcgacggctgctcgaagagctacgtgttccgtggcgtgaaggacctgactgccaagcagatccaggacatgttgggcattggcaagatggccgccgctccacagcccatgcaacagcgcattcccggcgccgctccctccgcacctgtcaacagatttcttcagcctgtcggaaagtgcgatatgagtttaactgatctgcttggggaattgcaaagagatccatggaatgtggctcagggcaagagacctctccgatctactggagttgc

SEQ ID NO: 1618 - DNA, 45 bp, Artificial sequence
  Primer sequence
gcgtaatacgactcactatagggcttgttgttcccgttggatgtc

SEQ ID NO: 1619 - DNA, 25 bp, Artificial sequence
  Primer sequence
gcaactccagtagatcggagaggtc

SEQ ID NO: 1620 - DNA, 23 bp, Artificial sequence
  Primer sequence
gcttgttgttcccgttggatgtc

SEQ ID NO: 1621 - DNA, 47 bp, Artificial sequence
  Primer sequence
gcgtaatacgactcactatagggcaactccagtagatcggagaggtc

SEQ ID NO: 1622 - DNA, 453 bp, Nilaparvata lugens
gttgccacccttggagttgaagttcacccccttgtatttcacacaaacagaggtgtgattaggttcaatgtgtgggacacagctggccaggaaaagttcggtggacttcgtgatggatattacattcagggacaatgcgccatcattatgtttgacgtaacgtcaagagtcacctacaagaacgttcccaactggcacagagatttagtgagggtttgcgaaaacattcccattgtactatgcggcaacaaagtagacatcaaggacaggaaagtcaaggccaagagcatagtcttccataggaagaagaaccttcagtactacgacatcagtgcgaaaagcaactacaacttcgagaagccgttcctgtggttggcaaagaagctgatcggtgaccccaacctggagttcgtcgccatgcccgccctcctcccacccgaggtcacaatggac

SEQ ID NO: 1623 - DNA, 26 bp, Artificial sequence
  Primer sequence
cccactttcaagtgygtrytrgtcgg

SEQ ID NO: 1624 - DNA, 21 bp, Artificial sequence
  Primer sequence
gtccattgtgacctcgggagg

SEQ ID NO: 1625 - DNA, 22 bp, Artificial sequence
  Primer sequence
gttgccacccttggagttgaag

SEQ ID NO: 1626 - DNA, 43 bp, Artificial sequence
  Primer sequence
gcgtaatacgactcactatagggtccattgtgacctcgggagg

SEQ ID NO: 1627 - DNA, 169 bp, Nilaparvata lugens; identical to SEQ ID NO: 1093

SEQ ID NO: 1628 - DNA, 45 bp, Artificial sequence
  Primer sequence
gcgtaatacgactcactatagggcagcagacgcaggcacaggtag

SEQ ID NO: 1629 - DNA, 27 bp, Artificial sequence
  Primer sequence
gaatttcctcttgagtttgccagcttg

SEQ ID NO: 1630 - DNA, 23 bp, Artificial sequence
  Primer sequence
gcagcagacgcaggcacaggtag

SEQ ID NO: 1631 - DNA, 49 bp, Artificial sequence
  Primer sequence
gcgtaatacgactcactatagggaatttcctcttgagtttgccagcttg

SEQ ID NO: 1632 - DNA, 346 bp, Nilaparvata lugens
cgcagagcaagtctacatctcttcactggccttattgaaaatgcttaagcacggtcgcgccggtgttcccatggaagttatgggcctaatgctgggcgaatttgtagacgactacactgtgcgtgtcattgatgtattcgctatgccacagagtggaacgggagtgagtgtggaggctgtagacccggtgttccaagcgaagatgttggacatgctaaagcagacaggacggcccgagatggtggtgggctggtaccactcgcacccgggcttcggctgctggctgtcgggtgtcgacatcaacacgcaggagagcttcgagcaactatccaagagagccgttgcc

SEQ ID NO: 1633 - DNA, 46 bp, Artificial sequence
  Primer sequence
gcgtaatacgactcactataggcgcagagcaagtctacatctcttc

SEQ ID NO: 1634 - DNA, 21 bp, Artificial sequence
  Primer sequence
ggcaacggctctcttggatag

SEQ ID NO: 1635 - DNA, 24 bp, Artificial sequence
  Primer sequence
cgcagagcaagtctacatctcttc

SEQ ID NO: 1636 - DNA, 43 bp, Artificial sequence
  Primer sequence
gcgtaatacgactcactataggggcaacggctctcttggatag

SEQ ID NO: 1637 - DNA, 592 bp, Nilaparvata lugens
cattgagcaagaagccaatgagaaagccgaagagatcgatgccaaggccgaggaagaattcaacattgaaaagggaaggctcgtacagcaccagcgccttaaaatcatggagtactatgacaggaaagagaagcaggttgagctccagaaaaaaatccaatcgtcaaacatgctgaaccaagcgcgtctgaaggcactgaaggtgcgcgaagatcacgtgagaagtgtgctcgaagaatccagaaaacgtcttggagaagtaaccagaaacccagccaagtacaaggaagtcctccagtatctaattgtccaaggactcctgcagctgctagaatcaaacgtagtactgcgcgtgcgcgaggctgacgtgagtctgatcgagggcattgttggctcatgcgcagagcagtacgcgaagatgaccggcaaagaggtggtggtgaagctggacgctgacaacttcctggccgccgagacgtgtggaggcgtcgagttgttcgcccgcaacggccgcatcaagatccccaacaccctcgagtccaggctcgacctcatctcccagcaacttgtgcccgagattagagtcgcgctc

SEQ ID NO: 1638 - DNA, 44 bp, Artificial sequence
  Primer sequence
gcgtaatacgactcactataggcattgagcaagaagccaatgag

SEQ ID NO: 1639 - DNA, 20 bp, Artificial sequence
  Primer sequence
gagcgcgactctaatctcgg

SEQ ID NO: 1640 - DNA, 22 bp, Artificial sequence
  Primer sequence
cattgagcaagaagccaatgag

SEQ ID NO: 1641 - DNA, 42 bp, Artificial sequence
  Primer sequence
gcgtaatacgactcactatagggagcgcgactctaatctcgg

SEQ ID NO: 1642 - DNA, 811 bp, Nilaparvata lugens
ctgcgagtgcgcttgtccgacattgtctcgatccagccttgcccagacgtcaagtatggaaagcgtatccatgtgctgcccattgatgataccgttgagggtcttacaggaaatctgttcgaagtgtatttgaagccatacttcctggaagcatacaggccaattcacaaggatgatgcattcattgttcgcggaggtatgagagcggtcgaattcaaggtggttgaaacagatccatcgccctactgcattgtcgcgccagacaccgtcatccattgtgagggagaccccatcaaacgtgaggatgaagaagacgcagcaaacgcagtcggctacgacgacattggaggctgcagaaagcagctggcgcagatcaaagagatggtggagttgccgctgagacatcccagtctgttcaaggcgatcggcgtgaagccgccacgaggcatcctgctgtacggaccaccgggaaccggaaagacgttgatagcgcgcgccgtcgccaacgaaacgggcgccttcttcttcctcatcaacggacccgagattatgagcaaattggccggcgagtcggagagtaacctgcgcaaagctttcgaggaagcggacaaaaacgcaccggccatcatcttcatcgatgagctggacgcaatcgcgccaaaacgcgagaagacgcacggcgaggtggagcgacgcatcgtgtcgcagctgctgacgctgatggacggtctcaagcagagctcgcacgtgattgtcatggccgccaccaatcggcccaactcgatcgatgccgcgcttaggcgctttggcc

SEQ ID NO: 1643 - DNA, 41 bp, Artificial sequence
  Primer sequence
gcgtaatacgactcactataggctgcgagtgcgcttgtccg

SEQ ID NO: 1644 - DNA, 19 bp, Artificial sequence
  Primer sequence
ggccaaagcgcctaagcgc

SEQ ID NO: 1645 - DNA, 19 bp, Artificial sequence
  Primer sequence
ctgcgagtgcgcttgtccg

SEQ ID NO: 1646 - DNA, 41 bp, Artificial sequence
  Primer sequence
gcgtaatacgactcactataggggccaaagcgcctaagcgc

SEQ ID NO: 1647 - DNA, 688 bp, Nilaparvata lugens
gacgccagtatcagaagacatgcttggtcgtgtattcaacggaagtggtaagcccatcgacaaaggacctcccattcttgctgaggattatctcgacattcaaggtcaacccatcaatccttggtcgcgtatctatcccgaggaaatgatccagactggaatttcagccatcgacgtcatgaactcgattgctcgtggccagaaaatccccatcttttcagctgccggtctacctcacaacgaaattgctgctcaaatctgtagacaggctggtcttgtcaaactgccaggaaagtcagttctcgatgactctgaggacaactttgctattgtattcgcagccatgggagtcaacatggaaactgctcgattcttcaaacaggatttcgaggagaacggctctatggagaacgtgtgcctgttcttgaacctggcgaacgacccgacgatcgagcgtatcatcacaccacgcctggcgctgacggccgccgagttcctggcctaccagtgcgagaagcacgtgctcgtcatcctcaccgacatgagctcctacgccgaggcgctgcgagaggtgtccgccgcccgcgaggaggtgcccggccgtcgtggtttccccggttacatgtacaccgatctggccaccatctacgagcgcgccggacgagtcgagggtcgcaacggctccatc

SEQ ID NO: 1648 - DNA, 45 bp, Artificial sequence
  Primer sequence
gcgtaatacgactcactatagggacgccagtatcagaagacatgc

SEQ ID NO: 1649 - DNA, 18 bp, Artificial sequence
  Primer sequence
gatggagccgttgcgacc

SEQ ID NO: 1650 - DNA, 23 bp, Artificial sequence
  Primer sequence
gacgccagtatcagaagacatgc

SEQ ID NO: 1651 - DNA, 40 bp, Artificial sequence
  Primer sequence
gcgtaatacgactcactatagggatggagccgttgcgacc

SEQ ID NO: 1652 - DNA, 828 bp, Nilaparvata lugens
gcaaatgcctgtgccacgcccacaaatagaaagcacacaacagtttattcgatccgagaaaacaacatactcgaatggattcaccaccattgaggaggacttcaaagtagacactttcgaataccgtcttctgcgcgaggtgtcgttccgcgaatctctgatcagaaactacttgcacgaggcggacatgcagatgtcgacggtggtggaccgagcattgggtcccccctcggcgccacacatccagcagaagccgcgcaactcaaaaatccaggagggcggcgatgccgtcttttccatcaagctcagcgccaaccccaagcctcggctggtctggttcaagaacggtcagcgcatcggtcagacgcagaaacaccaggcctcctactccaatcagaccgccacgctcaaggtcaacaaagtcagcgctcaagactccggccactacacgctgcttgctgaaaatccgcaaggatgtactgtgtcctcagcttacctagctgtcgaatcagctggcactcaagatacaggatacagtgagcaatacagcagacaagaggtggagacgacagaggcggtggacagcagcaagatgctggcaccgaactttgttcgcgtgccggccgatcgcgacgcgagcgaaggcaagatgacgcggtttgactgccgcgtgacgggccgaccctacccggacgtggcctggttcatcaacggccaacaggtggctgacgacgccacgcacaagatcctcgtcaacgagtctggcaaccactcgctcatgatcaccggcgtcactcgcttggaccacggagtggtcggctgtattgc

SEQ ID NO: 1653 - DNA, 41 bp, Artificial sequence
  Primer sequence
gcgtaatacgactcactatagggcaaatgcctgtgccacgc

SEQ ID NO: 1654 - DNA, 21 bp, Artificial sequence
  Primer sequence
gcaatacagccgaccactccg

SEQ ID NO: 1655 - DNA, 19 bp, Artificial sequence
  Primer sequence
gcaaatgcctgtgccacgc

SEQ ID NO: 1656 - DNA, 43 bp, Artificial sequence
  Primer sequence
gcgtaatacgactcactatagggcaatacagccgaccactccg

SEQ ID NO: 1657 - DNA, 313 bp, Nilaparvata lugens
gcttcagatttgggacacggccggccaggagcggttccgcacgatcacatcgagctactaccggggcgcccacggcatcattgtggtgtacgactgcaccgaccaggagtcgttcaacaacctcaaacagtggctcgaggagattgaccgctacgcctgtgataatgtcaacaaactgctcgtcggcaacaagtgtgatcagaccaacaaaaaggtcgtcgactatacacaggctaaggaatacgccgaccagctgggcattccgttcctggagacgtcggcgaagaacgcgaccaatgtggagcaggcgttc

SEQ ID NO: 1658 - DNA, 43 bp, Artificial sequence
  Primer sequence
gcgtaatacgactcactatagggcttcagatttgggacacggc

SEQ ID NO: 1659 - DNA, 20 bp, Artificial sequence
  Primer sequence
gaacgcctgctccacattgg

SEQ ID NO: 1660 - DNA, 21 bp, Artificial sequence
  Primer sequence
gcttcagatttgggacacggc

SEQ ID NO: 1661 - DNA, 42 bp, Artificial sequence
  Primer sequence
gcgtaatacgactcactatagggaacgcctgctccacattgg

SEQ ID NO: 1662 - DNA, 443 bp, Nilaparvata lugens
cgtcagtctcaattctgtcaccgatatcagcaccacgttcattctcaagccacaagagaacgtgaagataacgcttgagggcgcacaggcctgtttcatttcacacgaacgacttgtgatctcactgaagggaggagaactctatgttctaactctctattccgatagtatgcgcagtgtgaggagttttcatctggagaaagctgctgccagtgtcttgactacttgtatctgtgtttgtgaggagaactatctgttccttggttcccgtcttggaaactcactgttgctcaggtttactgagaaggaattgaacctgattgagccgagggccatcgaaagctcacagtcccagaatccggccaagaagaaaaagctggatactttgggagattggatggcatctgacgtcactgaaatacgcgacctggatgaactagaag

SEQ ID NO: 1663 - DNA, 45 bp, Artificial sequence
  Primer sequence
gcgtaatacgactcactataggcgtcagtctcaattctgtcaccg

SEQ ID NO: 1664 - DNA, 22 bp, Artificial sequence
  Primer sequence
cttctagttcatccaggtcgcg

SEQ ID NO: 1665 - DNA, 23 bp, Artificial sequence
  Primer sequence
cgtcagtctcaattctgtcaccg

SEQ ID NO: 1666 - DNA, 44 bp, Artificial sequence
  Primer sequence
gcgtaatacgactcactataggcttctagttcatccaggtcgcg

SEQ ID NO: 1667 - DNA, 647 bp, Nilaparvata lugens
ctcacgagaggacgttgcacactgatatactgttcggtttggtgaaagatgtcgcccgattcagacctgacttgaagctgctcatatcaagcgccacactggatgctcagaaattctccgagtttttcgacgatgcacccatcttcaggattccgggccgtagatttccggtggacatctactacacaaaggcgcccgaggctgactacgtggacgcatgtgtcgtttcgatcctgcagatccacgccactcagccgctgggagacatcctggtcttcctcaccggtcaggaggagatcgaaacctgccaggagctgctgcaggacagagtgcgcaggcttgggtctcgtatcaaggagctgctcatattgcccgtctattccaacctacccagtgatatgcaggcaaagattttcctgcccactccaccaaatgctagaaaggtagtattggccacaaatattgcagaaacctcattgaccatcgacaatataatctacgtgattgatcctggtttttgtaagcagaataacttcaattcaaggactggaatggaatcgcttgttgtagtgcctgtttcaaaggcatcggccaatcagcgagcagggcgggcgggacgggtggcggccggcaagtgcttccgtctg

SEQ ID NO: 1668 - DNA, 44 bp, Artificial sequence
  Primer sequence
gcgtaatacgactcactataggctcacgagaggacgttgcacac

SEQ ID NO: 1669 - DNA, 19 bp, Artificial sequence
  Primer sequence
cagacggaagcacttgccg

SEQ ID NO: 1670 - DNA, 22 bp, Artificial sequence
  Primer sequence
ctcacgagaggacgttgcacac

SEQ ID NO: 1671 - DNA, 41 bp, Artificial sequence
  Primer sequence
gcgtaatacgactcactataggcagacggaagcacttgccg

SEQ ID NO: 1672 - DNA, 545 bp, Nilaparvata lugens
gtcctcggacgggaggtccacgtgtttaccgggattccgtttgcgaaacctcccatcggtccgttgcgattccgtaaaccggttcccgtcgacccgtggcacggcgttctggatgcgaccgcgcttcccaacagctgctaccaggaacggtacgagtatttcccgggcttcgagggagaggaaatgtggaatccgaatacgaatttgtccgaagattgtctgtatttgaacatatgggtgccgcaccggttgagaatccgacacagagccaacagcgaggagaataaaccaagagcgaaggtgccggtgctgatctggatctacggcgggggttacatgagcggcacagctacactggacgtgtacgatgctgacatggtggccgccacgagtgacgtcatcgtcgcctccatgcagtaccgagtgggtgcgttcggcttcctctacctcgcacaggacttgcctcgaggcagcgaggaggcgccgggcaacatggggctctgggaccaggcccttgccatccgctggctcaaggacaacattgc

SEQ ID NO: 1673 - DNA, 41 bp, Artificial sequence
  Primer sequence
gcgtaatacgactcactatagggtcctcggacgggaggtcc

SEQ ID NO: 1674 - DNA, 22 bp, Artificial sequence
  Primer sequence
gcaatgttgtccttgagccagc

SEQ ID NO: 1675 - DNA, 19 bp, Artificial sequence
  Primer sequence
gtcctcggacgggaggtcc

SEQ ID NO: 1676 - DNA, 44 bp, Artificial sequence
  Primer sequence
gcgtaatacgactcactatagggcaatgttgtccttgagccagc

SEQ ID NO: 1677 - DNA, 850 bp, Nilaparvata lugens; identical to SEQ ID NO: 1113

SEQ ID NO: 1678 - DNA, 40 bp, Artificial sequence
  Primer sequence
gcgtaatacgactcactataggagaagacggcacggtgcg

SEQ ID NO: 1679 - DNA, 25 bp, Artificial sequence
  Primer sequence
caatccagtttttacagtttcgtgc

SEQ ID NO: 1680 - DNA, 18 bp, Artificial sequence
  Primer sequence
agaagacggcacggtgcg

SEQ ID NO: 1681 - DNA, 47 bp, Artificial sequence
  Primer sequence
gcgtaatacgactcactataggcaatccagtttttacagtttcgtgc

SEQ ID NO: 1682 - DNA, 655 bp, Chilo suppressalis
taaagcatggatgttggacaaactgggtggcgtgtacgcgccgcggccgtcgaccggcccccacaagttgcgcgagtgcctgccgctggtgatcttcctcaggaaccggctcaagtacgcgctcaccggaaatgaagtgcttaagattgtaaagcagcgacttatcaaagttgacggcaaagtcaggacagaccccacatatcccgctggatttatggatgttgtttccattgaaaagacaaatgagctgttccgtcttatatatgatgtcaaaggcagatttactattcaccgtattactcctgaggaggctaaatacaagctgtgcaaggtgcggcgcgtggcgacgggccccaagaacgtgccttacctggtgacccacgacggacgcaccgtgcgataccccgacccactcatcaaggtcaacgactccatccagctcgacatcgccacctccaagatcatggacttcatcaagtttgaatctggtaacctatgtatgatcacgggaggccgtaacttggggcgcgtgggcaccatcgtgtcccgcgagcgacatcccgggtccttcgacatcgtgcatatacgggactccaccggacataccttcgctaccagattgaacaacgtgttcataatcggcaagggcacgaag

SEQ ID NO: 1683 - DNA, 160 bp, Chilo suppressalis
  misc_feature (22)..(22): n is a, c, g, or t
  misc_feature (29)..(29): n is a, c, g, or t
  misc_feature (55)..(55): n is a, c, g, or t
  misc_feature (81)..(81): n is a, c, g, or t
  misc_feature (97)..(97): n is a, c, g, or t
  misc_feature (110)..(110): n is a, c, g, or t
  misc_feature (117)..(117): n is a, c, g, or t
  misc_feature (143)..(144): n is a, c, g, or t
kawmdkggvyarstghkrcvrnrkyatgnvkvkrkvdgkvrtdtyagmdvvsktnrydvkgrthrtakykckvrrvatgknvyvthdgrtvrydkvndsdatskmdksgncmtggrngrvgtvsrrhgsdvhrdstghtatrnnvgkgtkaysrgkgvrt

SEQ ID NO: 1684 - DNA, 396 bp, Chilo suppressalis
gagtttctttagtaaagtattcggtggcaagaaggaggagaagggtccatcaacacacgaagctatacagaaattacgcgaaacggaagagttattgcagaagaaacaagagtttctagagcgaaagatcgacactgaattacaaacggcgagaaaacatggcacaaagaataagagagctgccattgcggcactgaagcgcaagaagcgttatgaaaagcagcttacccagattgatggcacgcttacccaaattgaggcccaaagggaagcgctagaaggagctaacaccaatacacaggtgcttaacactatgcgagatgctgctaccgctatgagactcgcccacaaggatatcgatgtagacaaggtacacgatctgatggatgacattgc

SEQ ID NO: 1685 - DNA, 85 bp, Chilo suppressalis
  misc_feature (32)..(32): n is a, c, g, or t
  misc_feature (56)..(56): n is a, c, g, or t
  misc_feature (58)..(58): n is a, c, g, or t
  misc_feature (61)..(61): n is a, c, g, or t
sskvggkkkgsthakrtkkrkdttarkhgtknkraaaakrkkryktdgttaragantntvntmrdaatamrahkddvdkvhdmdd

SEQ ID NO: 1686 - DNA, 406 bp, Chilo suppressalis
tggtctccgcaacaagcgtgaggtgtggagggtgaagtacacgctggccaggatccgtaaggctgcccgtgagctgctcacactcgaggagaaagaccctaagaggttattcgaaggtaatgctctccttcgtcgtctggtgaggatcggtgtgttggatgagaagcagatgaagctcgattatgtactcggtctgaagattgaggacttcttggaacgtcgtctccagactcaggtgttcaaggctggtctagctaagtctatccatcatgcccgtattcttatcagacagaggcacatccgtgtccgcaagcaagttgtgaacatcccttcgttcatcgtgcggctggactctggcaagcacattgacttctcgctgaagtctccgttcggcggcggccggccg

SEQ ID NO: 1687 - DNA, 83 bp, Chilo suppressalis
  misc_feature (3)..(3): n is a, c, g, or t
  misc_feature (26)..(26): n is a, c, g, or t
  misc_feature (67)..(67): n is a, c, g, or t
grnkrvwrvkytarrkaartkdkrgnarrvrgvdkmkdyvgkdrrtvkagakshharrrhrvrkvvnsvrdsgkhdsksgggr

SEQ ID NO: 1688 - DNA, 530 bp, Chilo suppressalis
acctgccaaggaatgaggaacgctttgtatgacaaattggatgatgatggtataattgcaccagggattcgtgtatctggtgacgatgtagtcattggaaaaactataactttgccagaaaacgatgatgagctggaaggaacatcaagacgatacagtaagagagatgcctctacattcttgcgaaacagtgaaactggtattgttgaccaagttatgcttacacttaacagcgaaggatacaaattttgtaaaatacgtgtgagatctgtgagaatcccacaaattggagacaaatttgcttctcgtcatggtcaaaaagggacttgtggtattcaatataggcaagaagatatgcctttcacttgtgaaggattgacaccagatattatcatcaatccacatgctatcccctctcgtatgacaattggtcacttgattgaatgtattcaaggtaaggtctcctcaaataaaggtgaaataggtgatgctacaccatttaacgatgctgtcaacgtgcagaagatctc

SEQ ID NO: 1689 - DNA, 118 bp, Chilo suppressalis
  misc_feature (6)..(6): n is a, c, g, or t
  misc_feature (29)..(29): n is a, c, g, or t
  misc_feature (46)..(46): n is a, c, g, or t
  misc_feature (55)..(55): n is a, c, g, or t
  misc_feature (90)..(90): n is a, c, g, or t
  misc_feature (105)..(105): n is a, c, g, or t
  misc_feature (112)..(112): n is a, c, g, or t
  misc_feature (116)..(116): n is a, c, g, or t
tcgmrnaydkdddgagrvsgddvvgkttnddgtsrryskrdastrnstgvdvmtnsgykckrvrsvrgdkasrhgkgtcgyrdmtcgtdnhasrmtghcgkvssnkggdatndavnvk

SEQ ID NO: 1690 - DNA, 959 bp, Chilo suppressalis
tttcagagatttcttgttggaaccagagattttgggggctatcgtcgattgcggtttcgagcacccttcagaagttcaacatgaatgtattccccaagctgttttgggaatggatattctttgtcaaagctaaatccggaatgggaaaaaccgccgtatttgttttagcaacactgcaacagctagaaccttcagaaaaccatgtttacgtattagtaatgtgccatacaagggaactcgctttccaaataagcaaggaatatgagaggttctctaaatatatggctggtgttagagtatctgtattctttggtgggatgccaattcagaaagatgaagaagtattgaagacagcctgcccgcacatcgttgttggtactcctggcagaatattagcattggttaacaacaagaaactgaatttaaaacacctgaaacacttcatcctggatgaatgtgacaaaatgcttgaatctctagacatgagacgtgatgtgcaggaaatattcaggaacacccctcacggtaagcaggtcatgatgttttctgcaacattgagtaaggagatcagaccagtctgtaagaaatttatgcaagatcctatggaagtttatgtggatgatgaagctaaacttacattgcacggtttgcagcaacattatgttaaactcaaggaaaatgaaaagaataagaagttatttgaacttttggatgtactggagttcaaccaagttgtcatatttgtaaagtcagtgcagcgctgcatagctctcgcacagctgctgacagaccaaaacttcccagctattggtatacaccgaaatatgactcaagatgagcgtctctcccgctatcagcagttcaaagatttccagaagaggatccttgttgcgacaaatctttttggacggggtatggacattgaaagagtcaacatagtcttcaattatgacatgccg

SEQ ID NO: 1691 - DNA, 197 bp, Chilo suppressalis
  misc_feature (5)..(5): n is a, c, g, or t
  misc_feature (17)..(17): n is a, c, g, or t
  misc_feature (19)..(19): n is a, c, g, or t
  misc_feature (40)..(40): n is a, c, g, or t
  misc_feature (86)..(87): n is a, c, g, or t
  misc_feature (90)..(90): n is a, c, g, or t
  misc_feature (108)..(108): n is a, c, g, or t
  misc_feature (144)..(144): n is a, c, g, or t
  misc_feature (146)..(146): n is a, c, g, or t
  misc_feature (151)..(151): n is a, c, g, or t
  misc_feature (164)..(164): n is a, c, g, or t
  misc_feature (169)..(169): n is a, c, g, or t
  misc_feature (184)..(184): n is a, c, g, or t
  misc_feature (192)..(192): n is a, c, g, or t
  misc_feature (194)..(194): n is a, c, g, or t
sscwnrwgssavsstknmnvkwwvkaksgmgktavvatsnhvyvvmchtraskyrskymagvrvsvggmkdvktachvvgtgravnnkknkhkhdcdkmsdmrrdvrnthgkvmmsatskrvckkmdmvyvddakthghyvkknknkkdvnvvvksvrcaatdnaghrnmtdrsrykdkrvatngrgmdrvnvnydm

SEQ ID NO: 1692 - DNA, 542 bp, Chilo suppressalis
cctcgttgccatttgtatttggacgtttctgcagcggctggactcacgggagcccatgtggcagctggacgagagcatcatcggcaccaaccccgggctcggcttccggcccacgccgccagaggtcgccagcagcgtcatctggtataaaggcaacgaccccaacagccaacaattctgggtgcaagaaacctccaactttctaaccgcgtacaaacgagacggtaagaaagcaggagcaggccagaacatccacaactgtgatttcaaactgcctcctccggccggtaaggtgtgcgacgtggacatcagcgcctggagtccctgtgtagaggacaagcactttggataccacaagtccacgccctgcatcttcctcaaactcaacaagatcttcggctggaggccgcacttctacaacagctccgacagcctgcccactgacatgcccgacgacttgaaggagcacatcaggaatatgacagcgtacgataagaattatctaaacatggtatgggtgtcttgcgagggagagaatccag

SEQ ID NO: 1693 - DNA, 120 bp, Chilo suppressalis
  misc_feature (16)..(16): n is a, c, g, or t
  misc_feature (30)..(30): n is a, c, g, or t
  misc_feature (32)..(32): n is a, c, g, or t
  misc_feature (38)..(38): n is a, c, g, or t
  misc_feature (52)..(52): n is a, c, g, or t
  misc_feature (54)..(54): n is a, c, g, or t
  misc_feature (83)..(83): n is a, c, g, or t
  misc_feature (90)..(90): n is a, c, g, or t
  misc_feature (103)..(103): n is a, c, g, or t
  misc_feature (110)..(110): n is a, c, g, or t
  misc_feature (112)..(112): n is a, c, g, or t
  misc_feature (120)..(120): n is a, c, g, or t
vacwtrdsrmwdsgtnggrtvassvwykgndnswvtsntaykrdgkkagagnhncdkagkvcdvdsawscvdkhgyhkstcknkgwrhynssdstdmddkhrnmtaydknynmvwvscgn

SEQ ID NO: 1694 - DNA, 495 bp, Chilo suppressalis
ggctccggcaagacgacctttgtcaaacgacacttgactggagagttcgagaaaagatatgtcgccacattaggtgtcgaggtgcatcccttagtattccacacaaatagaggccctataaggtttaatgtatgggatactgctggccaagaaaagtttggtggtctccgagatggttactatatccaaggtcaatgtgccatcatcatgttcgatgtaacgtctcgtgtcacctacaaaaatgtacccaactggcacagagatttagtgcgagtctgtgaaggcattccaattgttctttgtggcaacaaagtagatatcaaggacagaaaagtcaaagcaaaaactattgttttccacagaaaaaagaaccttcagtattatgacatctctgccaagtcaaactacaatttcgagaaacccttcctctggttagcgagaaagttgatcggtgatggtaacctagagtttgtcgccatgcagccctgcttccac

SEQ ID NO: 1695 - DNA, 115 bp, Chilo suppressalis
  misc_feature (26)..(26): n is a, c, g, or t
  misc_feature (30)..(30): n is a, c, g, or t
  misc_feature (58)..(58): n is a, c, g, or t
  misc_feature (60)..(60): n is a, c, g, or t
  misc_feature (73)..(73): n is a, c, g, or t
  misc_feature (91)..(91): n is a, c, g, or t
  misc_feature (99)..(99): n is a, c, g, or t
  misc_feature (101)..(101): n is a, c, g, or t
  misc_feature (110)..(110): n is a, c, g, or t
gsgkttvkrhtgkryvatgvvhvhtnrgrnvwdtagkggrdgyygcamdvtsrvtyknvnwhrdvrvcgvcgnkvdkdrkvkaktvhrkknyydsaksnynkwarkgdgnvamch

SEQ ID NO: 1696 - DNA, 401 bp, Chilo suppressalis
cagatgcgcccgttgttgatactgccgaacaggtatacatctcgtctttggccctgttgaagatgttaaaacacgggcgcgccggtgttccaatggaagttatgggacttatgttaggtgaatttgttgatgattacacggtgcgtgtcatagacgtatttgccatgcctcaaactggcacaggagtgtcggttgaagctgtagatcctgtcttccaagcaaagatgttggatatgttgaagcaaactggacgacctgagatggtagtgggatggtaccactcgcatcctggctttggatgttggttatctggagtcgacattaatactcagcagtctttcgaagctttgtctgaacgtgctgtagctgtagtggttgatcccattcagtctgtcaagggc

SEQ ID NO: 1697 - DNA, 93 bp, Chilo suppressalis
  misc_feature (77)..(77): n is a, c, g, or t
davvdtavyssakmkhgragvmvmgmgvddytvrvdvamtgtgvsvavdvakmdmktgrmvvgwyhshggcwsgvdntsasravavvvdsvkg

SEQ ID NO: 1698 - DNA, 626 bp, Chilo suppressalis
ttcaaaagcagatcaagcatatgatggccttcatcgaacaagaggctaatgaaaaggccgaggaaatcgatgcaaaggccgaagaggagttcaacattgaaaaaggccgcctggtgcagcagcagcggctcaagatcatggaatactacgaaaagaaagagaaacaagtggaactccagaaaaagatccaatcttcgaacatgctgaatcaagcccgtctgaaggtgctcaaagtgcgtgaggaccacgtacgcaacgttctcgacgaggctcgcaagcgcctggctgaggtgcccaaagacgtgaaactttacacagatctgctggtcacgctcgtcgtacaagccctattccagctcatggaacccacagtaacagttcgcgttaggcaggcggacgtctccttagtacagtccatattgggcaaggcacagcaggattacaaagcaaagatcaagaaggacgttcaattgaagatcgacaccgagaattccctgcccgccgatacttgtggcggagtggaacttattgctgctagagggcgtattaagatcagcaacactctggagtctcgtctggagctgatagcccaacaactgttgcccgaaatacgtaccgcattgttc

SEQ ID NO: 1699 - DNA, 120 bp, Chilo suppressalis
  misc_feature (8)..(8): n is a, c, g, or t
  misc_feature (15)..(15): n is a, c, g, or t
  misc_feature (33)..(33): n is a, c, g, or t
  misc_feature (35)..(35): n is a, c, g, or t
  misc_feature (47)..(47): n is a, c, g, or t
  misc_feature (97)..(97): n is a, c, g, or t
  misc_feature (113)..(113): n is a, c, g, or t
kkhmmaankadakankgrvrkmyykkkvkkssnmnarkvkvrdhvrnvdarkravkdvkytdvtvvamtvtvrvradvsvsgkadykakkkdvkdtnsadtcggvaargrksntsrarta

SEQ ID NO: 1700 - DNA, 864 bp, Chilo suppressalis
atcgtgctttcagacgataactgccccgatgagaagatccgcatgaaccgcgtcgtgcgaaacaacttgcgtgtacgcctgtcagacatagtctccatagcgccttgtccatcggtcaaatatgggaaacgggtacatatattgcccattgatgattctgtcgagggtttgactggaaatttattcgaagtctacttgaaaccatacttcatggaagcttatcggcctatccatcgcgatgacacattcatggttcgcgggggcatgagggctgttgaattcaaagtggtggagactgatccgtcgccgtattgcatcgtcgctcccgacacagtgatacactgcgaaggagaccctatcaaacgagaggaagaagaagaagccctaaacgccgtagggtacgacgacatcggtggctgtcgtaaacagctcgctcagatcaaagagatggtcgagttgcctctaaggcatccgtcgctgttcaaggcaattggtgtgaagccgccacgtggaatcctcatgtatgggccgcctggtaccggcaaaactctcattgctcgggcagtggctaatgaaactggtgcattcttctttctgatcaacgggccggagatcatgtccaaactcgcgggcgagtccgaatcgaaccttcgcaaggcattcgaggaagcggacaagaactccccggctataatcttcatcgatgaactggatgccatcgcaccaaagagggagaagactcacggtgaagtggagcgtcgtattgtgtcgcaactacttactcttatggatggaatgaagaagtcatcgcacgtgatcgtaatggccgccaccaaccgtccgaattcgatcgacccggcgcta

SEQ ID NO: 1701 - DNA, 184 bp, Chilo suppressalis
  misc_feature (5)..(5): n is a, c, g, or t
  misc_feature (11)..(11): n is a, c, g, or t
  misc_feature (16)..(17): n is a, c, g, or t
  misc_feature (43)..(43): n is a, c, g, or t
  misc_feature (86)..(86): n is a, c, g, or t
  misc_feature (125)..(125): n is a, c, g, or t
  misc_feature (129)..(129): n is a, c, g, or t
  misc_feature (138)..(138): n is a, c, g, or t
  misc_feature (145)..(145): n is a, c, g, or t
  misc_feature (179)..(179): n is a, c, g, or t
  misc_feature (181)..(181): n is a, c, g, or t
vsddncdkrmnrvvrnnrvrsdvsacsvkygkrvhddsvgtgnvykymayrhrddtmvrggmravkvvtdsycvadtvhcgdkranavgyddggcrkakmvrhskagvkrgmyggtgktaravantgangmskagssnrkaadknsaddaakrkthgvrrvstmdgmkksshvvmaatnrnsda

SEQ ID NO: 1702 - DNA, 1144 bp, Chilo suppressalis
aggatggaagcggggatacgtttgagcatctccttggggaagatacggagcagctgccagccgatgtccagcgactcgaatactgtgcggttctcgtagttgccctgtgtgatgaagttcttctcgaacttggtgaggaactcgaggtagagcagatcgtcgggtgtcagggcttcctcaccgacgacagccttcatggcctgcacgtccttaccgatggcgtagcaggcgtacagctggttggaaacatcagagtggtccttgcgggtcattccctcaccgatggcagacttcatgagacgagacagggaaggcagcacgtttacaggcgggtagatctgtctgttgtggagctgacggtctacgtagatctgtccctcagtgatgtagcccgttaaatcgggaataggatgggtgatgtcgtcgttgggcatagtcaagatggggatctgcgtgatggatccgtttctaccctctacacgcccggctctctcgtagatggtggccaaatcggtgtacatgtaacctgggaaaccacgtcgtccgggcacctcctcacgggcggcggacacttcacgcagagcctccgcgtacgaagacatgtcagtcaagattaccagcacgtgtttctcacactggtaggccaagaactcagcagcagtcaaggccaaacgtggtgtgatgattctctcaatagtgggatcgttggccagattcaagaacaggcacacgttctccatggagccgttctcctcgaagtcctgcttgaagaaccgggccgtctccatgttcacacccatggcggcgaacacgatggcaaagttgtcctcgtggtcgtccagcacagatttgccggggatctttacaagaccggcttgcctacagatctgggcggcaatttcgttgtgtggcagaccggcagccgagaaaatggggatcttttgcccgcgagcaatggagttcatcacgtcgatagcggagataccagtctggatcatttcctcagggtagatacgggaccaggggttgatgggctgtccctggatgtccaaaaagtcttcagcaaggattgggggacctttgtcaatgggttttccagagccgttgaatacgcgacccaacatgtcttcggagacaggggtgc

SEQ ID NO: 1703 - DNA, 229 bp, Chilo suppressalis
  misc_feature (9)..(9): n is a, c, g, or t
  misc_feature (21)..(21): n is a, c, g, or t
  misc_feature (34)..(34): n is a, c, g, or t
  misc_feature (45)..(45): n is a, c, g, or t
  misc_feature (62)..(62): n is a, c, g, or t
  misc_feature (70)..(70): n is a, c, g, or t
  misc_feature (77)..(77): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (138)..(138): n is a, c, g, or t
  misc_feature (144)..(144): n is a, c, g, or t
  misc_feature (160)..(160): n is a, c, g, or t
  misc_feature (164)..(164): n is a, c, g, or t
  misc_feature (185)..(185): n is a, c, g, or t
  misc_feature (210)..(210): n is a, c, g, or t
  misc_feature (213)..(213): n is a, c, g, or t
  misc_feature (215)..(215): n is a, c, g, or t
tvsdmgrvngsgkdkgaddgnwsrymtgsadvmnsargksaaghnaacragvkgksvddhdnavaamgvnmtarkdngsmnvcnandtrtrataaayckhvvtdmssyaarvsaarvgrrggymytdatyragrvgrngsttmnddthdtgytgyvdrhnryvnvssrmksaggmtrkdhsdvsnyacyagkdvamkavvgatddytkkntgnynrtvsdgwrkmkras

SEQ ID NO: 1704 - DNA, 1225 bp, Chilo suppressalis
gctccgtctacattcagccggaaggcgtccctgtacctgctcagcaatcccaacagcagcagagttaccgccacgtcagcgagagcgtcgaacacaaatcctacggcacgcaagggtacaccacttcggaacagaccaagcagacacagaaggtggcgtacaccaacggttccgactactcttccacggacgactttaaggtggatacgttcgaatacagactcctccgagaagtttcgttcagggaatccatcacgaagcggtacattggcgagacagacattcagatcagcacggaggtcgacaagtctctcggtgtggtgacccctcctaagatagcacaaaagcctaggaattccaagctgcaggagggagccgacgctcagtttcaagtgcagctgtcgggtaacccgcggccacgggtgtcatggttcaagaacgggcagaggatagtcaactcgaacaaacacgaaatcgtcacgacacataatcaaacaatacttagggtaagaaacacacaaaagtctgatactggcaactacacgttgttggctgaaaatcctaacggatgcgtcgtcacatcggcatacctggccgtggagtcgcctcaagaaacttacggccaagatcataaatcacaatacataatggacaatcagcaaacagctgtagaagaaagagtagaagttaatgaaaaagctctcgctccgcaattcgtaagagtctgccaagaccgcgatgtaacggaggggaaaatgacgcgattcgattgccgcgtcacgggcagaccttacccagaagtcacgtggttcattaacgatagacaaattcgagacgattatwatcataagatattagtaaacgaatcgtgtaatcatgcacttatgattacaaacgtcgatctcagtgatagtggcgtagtatcatgtatagcacgcaacaagaccggcgaaacttcgtttcagtgtaggctgaacgtgatagagaaggagcaagtggtcgctcccaaattcgtggagcggttcagcacgctcaacgtgcgcgagggcgagcccgtgcagctgcacgcgcgcgccgtcggcacgcctacgccacgcatcacatggcagaaggacggcgttcaagttatacccaatccagagctacgaataaataccgaaggtggggcctcgacgctggacatccctcgagccaaggcgtcggacgcgggatggtaccgatgcac

SEQ ID NO: 1705 - DNA, 275 bp, Chilo suppressalis
  misc_feature (36)..(36): n is a, c, g, or t
  misc_feature (78)..(78): n is a, c, g, or t
  misc_feature (88)..(88): n is a, c, g, or t
  misc_feature (95)..(95): n is a, c, g, or t
  misc_feature (99)..(99): n is a, c, g, or t
  misc_feature (101)..(101): n is a, c, g, or t
  misc_feature (108)..(108): n is a, c, g, or t
  misc_feature (113)..(113): n is a, c, g, or t
  misc_feature (120)..(120): n is a, c, g, or t
  misc_feature (124)..(125): n is a, c, g, or t
  misc_feature (147)..(147): n is a, c, g, or t
  misc_feature (154)..(154): n is a, c, g, or t
  misc_feature (183)..(183): n is a, c, g, or t
  misc_feature (193)..(193): n is a, c, g, or t
  misc_feature (196)..(196): n is a, c, g, or t
  misc_feature (201)..(201): n is a, c, g, or t
  misc_feature (214)..(214): n is a, c, g, or t
  misc_feature (222)..(222): n is a, c, g, or t
  misc_feature (233)..(233): n is a, c, g, or t
  misc_feature (254)..(254): n is a, c, g, or t
  misc_feature (256)..(256): n is a, c, g, or t
svygvvassyrhvssvhksygtgyttstktkvaytngsdysstddkvdtyrrvsrstkrygtdstvdksgvvtkakrnskgadavsgnrrvswkngrvnsnkhvtthntrvrntksdtgnytanngcvvtsayavstygdhksymdntavrvvnkaavrvcdrdvtgkmtrdcrvtgryvtwndrrddyhkvnscnhamtnvdsdsgvvscarnktgtscrnvkvvakvrstnvrgvharavgttrtwkdgvvnrntggastdrakasdagwyrc

SEQ ID NO: 1706 - DNA, 23 bp, Artificial sequence
  Primer sequence
catttgaagcgtttwrmygcycc

SEQ ID NO: 1707 - DNA, 28 bp, Artificial sequence
  Primer sequence
cttcgtgcccttgccratkatraabacg

SEQ ID NO: 1708 - DNA, 27 bp, Artificial sequence
  Primer sequence
gagtttctttagtaaagtattcggtgg

SEQ ID NO: 1709 - DNA, 26 bp, Artificial sequence
  Primer sequence
gcaatgtcatccatcakrtcrtgtac

SEQ ID NO: 1710 - DNA, 26 bp, Artificial sequence
  Primer sequence
caggagttgarrathatygghsarta

SEQ ID NO: 1711 - DNA, 24 bp, Artificial sequence
  Primer sequence
caggttcttcctcttkacrcgdcc

SEQ ID NO: 1712 - DNA, 23 bp, Artificial sequence
  Primer sequence
acctgccaaggaatgmgvaaygc

SEQ ID NO: 1713 - DNA, 26 bp, Artificial sequence
  Primer sequence
gagatcttctgcacrttkacvgcatc

SEQ ID NO: 1714 - DNA, 22 bp, Artificial sequence
  Primer sequence
cggtgtccattcacagytccgg

SEQ ID NO: 1715 - DNA, 26 bp, Artificial sequence
  Primer sequence
cgatgcaagtaggtgtckgartcytc

SEQ ID NO: 1716 - DNA, 22 bp, Artificial sequence
  Primer sequence
cctcgttgccatytgywtktgg

SEQ ID NO: 1717 - DNA, 26 bp, Artificial sequence
  Primer sequence
ctggattctctccctcgcamgahacc

SEQ ID NO: 1718 - DNA, 24 bp, Artificial sequence
  Primer sequence
ggctccggcaagacvacmttygtc

SEQ ID NO: 1719 - DNA, 25 bp, Artificial sequence
  Primer sequence
gtggaagcagggcwggcatkgcrac

SEQ ID NO: 1720 - DNA, 24 bp, Artificial sequence
  Primer sequence
ggatcgtctgctamgwytwggagg

SEQ ID NO: 1721 - DNA, 21 bp, Artificial sequence
  Primer sequence
ctatggtgtccagcatsgcgc

SEQ ID NO: 1722 - DNA, 22 bp, Artificial sequence
  Primer sequence
atggcactgagcgaygchgatg

SEQ ID NO: 1723 - DNA, 24 bp, Artificial sequence
  Primer sequence
gaacttgcggttgabgttscgdcc

SEQ ID NO: 1724 - DNA, 20 bp, Artificial sequence
  Primer sequence
gccgcaaggagacbgtvtgc

SEQ ID NO: 1725 - DNA, 23 bp, Artificial sequence
  Primer sequence
cgatcaaagcgwccraavcgacg

SEQ ID NO: 1726 - DNA, 21 bp, Artificial sequence
  Primer sequence
gttcaccggcgayatyctgcg

SEQ ID NO: 1727 - DNA, 21 bp, Artificial sequence
  Primer sequence
gtcgcgcaggtagaaytckgc

SEQ ID NO: 1728 - DNA, 25 bp, Artificial sequence
  Primer sequence
  misc_feature (20)..(20): n is a, c, g, or t
gctccgtctacathcarccngargg

SEQ ID NO: 1729 - DNA, 23 bp, Artificial sequence
  Primer sequence
gtgcatcggtaccahschgcrtc

SEQ ID NO: 1730 - DNA, 21 bp, Chilo suppressalis
aaagcatggatgttggacaaa

SEQ ID NO: 1731 - DNA, 23 bp, Chilo suppressalis
aaagcatggatgttggacaaact

SEQ ID NO: 1732 - DNA, 23 bp, Chilo suppressalis
aaccggctcaagtacgcgctcac

SEQ ID NO: 1733 - DNA, 26 bp, Chilo suppressalis
aaccggctcaagtacgcgctcaccgg

SEQ ID NO: 1734 - DNA, 23 bp, Chilo suppressalis
aagatcatggacttcatcaagtt

SEQ ID NO: 1735 - DNA, 23 bp, Chilo suppressalis
accagattgaacaacgtgttcat

SEQ ID NO: 1736 - DNA, 26 bp, Chilo suppressalis
atcatggacttcatcaagtttgaatc

SEQ ID NO: 1737 - DNA, 24 bp, Chilo suppressalis
caagatcatggacttcatcaagtt

SEQ ID NO: 1738 - DNA, 21 bp, Chilo suppressalis
ccccacaagttgcgcgagtgc

SEQ ID NO: 1739 - DNA, 23 bp, Chilo suppressalis
cccgctggatttatggatgttgt

SEQ ID NO: 1740 - DNA, 28 bp, Chilo suppressalis
cctccaagatcatggacttcatcaagtt

SEQ ID NO: 1741 - DNA, 21 bp, Chilo suppressalis
cctgccgctggtgatcttcct

SEQ ID NO: 1742 - DNA, 22 bp, Chilo suppressalis
cgacgggccccaagaacgtgcc

SEQ ID NO: 1743 - DNA, 21 bp, Chilo suppressalis
ctcatcaaggtcaacgactcc

SEQ ID NO: 1744 - DNA, 35 bp, Chilo suppressalis
ctcatcaaggtcaacgactccatccagctcgacat

SEQ ID NO: 1745 - DNA, 43 bp, Chilo suppressalis
ctcatcaaggtcaacgactccatccagctcgacatcgccacct

SEQ ID NO: 1746 - DNA, 21 bp, Chilo suppressalis
ctgccgctggtgatcttcctc

SEQ ID NO: 1747 - DNA, 23 bp, Chilo suppressalis
gaccccacatatcccgctggatt

SEQ ID NO: 1748 - DNA, 21 bp, Chilo suppressalis
gcagcgacttatcaaagttga

SEQ ID NO: 1749 - DNA, 23 bp, Chilo suppressalis
gcatggatgttggacaaactggg

SEQ ID NO: 1750 - DNA, 26 bp, Chilo suppressalis
gccacctccaagatcatggacttcat

SEQ ID NO: 1751 - DNA, 30 bp, Chilo suppressalis
gcgcgtggcgacgggccccaagaacgtgcc

SEQ ID NO: 1752 - DNA, 22 bp, Chilo suppressalis
gctggatttatggatgttgttt

SEQ ID NO: 1753 - DNA, 22 bp, Chilo suppressalis
ggctcaagtacgcgctcaccgg

SEQ ID NO: 1754 - DNA, 24 bp, Chilo suppressalis
gtgggcaccatcgtgtcccgcgag

SEQ ID NO: 1755 - DNA, 26 bp, Chilo suppressalis
gtgggcaccatcgtgtcccgcgagcg

SEQ ID NO: 1756 - DNA, 35 bp, Chilo suppressalis
gtgggcaccatcgtgtcccgcgagcgacatcccgg

SEQ ID NO: 1757 - DNA, 21 bp, Chilo suppressalis
taaagcatggatgttggacaa

SEQ ID NO: 1758 - DNA, 22 bp, Chilo suppressalis
taaagcatggatgttggacaaa

SEQ ID NO: 1759 - DNA, 24 bp, Chilo suppressalis
taaagcatggatgttggacaaact

SEQ ID NO: 1760 - DNA, 27 bp, Chilo suppressalis
taaagcatggatgttggacaaactggg

SEQ ID NO: 1761 - DNA, 38 bp, Chilo suppressalis
tacaagctgtgcaaggtgcggcgcgtggcgacgggccc

SEQ ID NO: 1762 - DNA, 41 bp, Chilo suppressalis
tacaagctgtgcaaggtgcggcgcgtggcgacgggccccaa

SEQ ID NO: 1763 - DNA, 23 bp, Chilo suppressalis
taccccgacccactcatcaaggt

SEQ ID NO: 1764 - DNA, 22 bp, Chilo suppressalis
tgaacaacgtgttcataatcgg

SEQ ID NO: 1765 - DNA, 22 bp, Chilo suppressalis
tgcgcgagtgcctgccgctggt

SEQ ID NO: 1766 - DNA, 29 bp, Chilo suppressalis
tgtatgatcacgggaggccgtaacttggg

SEQ ID NO: 1767 - DNA, 32 bp, Chilo suppressalis
tgtatgatcacgggaggccgtaacttggggcg

SEQ ID NO: 1768 - DNA, 57 bp, Chilo suppressalis
tgtatgatcacgggaggccgtaacttggggcgcgtgggcaccatcgtgtcccgcgag

SEQ ID NO: 1769 - DNA, 35 bp, Chilo suppressalis
tgtgcaaggtgcggcgcgtggcgacgggccccaag

SEQ ID NO: 1770 - DNA, 35 bp, Chilo suppressalis
ttgaacaacgtgttcataatcggcaagggcacgaa

SEQ ID NO: 1771 - DNA, 29 bp, Chilo suppressalis
attgaggcccaaagggaagcgctagaagg

SEQ ID NO: 1772 - DNA, 22 bp, Chilo suppressalis
cacgatctgatggatgacattg

SEQ ID NO: 1773 - DNA, 27 bp, Chilo suppressalis
gagtttctttagtaaagtattcggtgg

SEQ ID NO: 1774 - DNA, 23 bp, Chilo suppressalis
tatgaaaagcagcttacccagat

SEQ ID NO: 1775 - DNA, 23 bp, Chilo suppressalis
aggcacatccgtgtccgcaagca

SEQ ID NO: 1776 - DNA, 21 bp, Chilo suppressalis
aagattgaggacttcttggaa

SEQ ID NO: 1777 - DNA, 23 bp, Chilo suppressalis
aagcacattgacttctcgctgaa

SEQ ID NO: 1778 - DNA, 23 bp, Chilo suppressalis
atcagacagaggcacatccgtgt

SEQ ID NO: 1779 - DNA, 21 bp, Chilo suppressalis
atccgtaaggctgcccgtgag

SEQ ID NO: 1780 - DNA, 24 bp, Chilo suppressalis
atccgtaaggctgcccgtgagctg

SEQ ID NO: 1781 - DNA, 26 bp, Chilo suppressalis
atccgtaaggctgcccgtgagctgct

SEQ ID NO: 1782 - DNA, 29 bp, Chilo suppressalis
atccgtaaggctgcccgtgagctgctcac

SEQ ID NO: 1783 - DNA, 22 bp, Chilo suppressalis
cacatccgtgtccgcaagcaag

SEQ ID NO: 1784 - DNA, 23 bp, Chilo suppressalis
cacatccgtgtccgcaagcaagt

SEQ ID NO: 1785 - DNA, 25 bp, Chilo suppressalis
cacatccgtgtccgcaagcaagttg

SEQ ID NO: 1786 - DNA, 21 bp, Chilo suppressalis
cgcaacaagcgtgaggtgtgg

SEQ ID NO: 1787 - DNA, 29 bp, Chilo suppressalis
cgtgtccgcaagcaagttgtgaacatccc

SEQ ID NO: 1788 - DNA, 30 bp, Chilo suppressalis
ctcgctgaagtctccgttcggcggcggccg

SEQ ID NO: 1789 - DNA, 23 bp, Chilo suppressalis
ctcggtctgaagattgaggactt

SEQ ID NO: 1790 - DNA, 29 bp, Chilo suppressalis
ctggactctggcaagcacattgacttctc

SEQ ID NO: 1791 - DNA, 32 bp, Chilo suppressalis
gacttctcgctgaagtctccgttcggcggcgg

SEQ ID NO: 1792 - DNA, 35 bp, Chilo suppressalis
gacttctcgctgaagtctccgttcggcggcggccg

SEQ ID NO: 1793 - DNA, 35 bp, Chilo suppressalis
gaggagaaagaccctaagaggttattcgaaggtaa

SEQ ID NO: 1794 - DNA, 21 bp, Chilo suppressalis
gatccgtaaggctgcccgtga

SEQ ID NO: 1795 - DNA, 27 bp, Chilo suppressalis
gatccgtaaggctgcccgtgagctgct

SEQ ID NO: 1796 - DNA, 32 bp, Chilo suppressalis
gattatgtactcggtctgaagattgaggactt

SEQ ID NO: 1797 - DNA, 26 bp, Chilo suppressalis
ggtctgaagattgaggacttcttgga

SEQ ID NO: 1798 - DNA, 23 bp, Chilo suppressalis
gtgtggagggtgaagtacacgct

SEQ ID NO: 1799 - DNA, 26 bp, Chilo suppressalis
gtgttcaaggctggtctagctaagtc

SEQ ID NO: 1800 - DNA, 35 bp, Chilo suppressalis
gtgttggatgagaagcagatgaagctcgattatgt

SEQ ID NO: 1801 - DNA, 22 bp, Chilo suppressalis
tgaagattgaggacttcttgga

SEQ ID NO: 1802 - DNA, 28 bp, Chilo suppressalis
tggactctggcaagcacattgacttctc

SEQ ID NO: 1803 - DNA, 22 bp, Chilo suppressalis
tggatgagaagcagatgaagct

SEQ ID NO: 1804 - DNA, 24 bp, Chilo suppressalis
tggtctccgcaacaagcgtgaggt

SEQ ID NO: 1805 - DNA, 28 bp, Chilo suppressalis
tggtctccgcaacaagcgtgaggtgtgg

SEQ ID NO: 1806 - DNA, 26 bp, Chilo suppressalis
cgtatgacaattggtcacttgattga

SEQ ID NO: 1807 - DNA, 26 bp, Chilo suppressalis
gaagatatgcctttcacttgtgaagg

SEQ ID NO: 1808 - DNA, 26 bp, Chilo suppressalis
ggaaaaactataactttgccagaaaa

SEQ ID NO: 1809 - DNA, 29 bp, Chilo suppressalis
ggtgatgctacaccatttaacgatgctgt

SEQ ID NO: 1810 - DNA, 26 bp, Chilo suppressalis
tctcgtatgacaattggtcacttgat

SEQ ID NO: 1811 - DNA, 22 bp, Chilo suppressalis
ctgtcaacgtgcagaagatctc

SEQ ID NO: 1812 - DNA, 26 bp, Chilo suppressalis
tggatgaatgtgacaaaatgcttgaa

SEQ ID NO: 1813 - DNA, 23 bp, Chilo suppressalis
tttatgcaagatcctatggaagt

SEQ ID NO: 1814 - DNA, 32 bp, Chilo suppressalis
aaatttatgcaagatcctatggaagtttatgt

SEQ ID NO: 1815 - DNA, 23 bp, Chilo suppressalis
aatatgactcaagatgagcgtct

SEQ ID NO: 1816 - DNA, 26 bp, Chilo suppressalis
atgactcaagatgagcgtctctcccg

SEQ ID NO: 1817 - DNA, 23 bp, Chilo suppressalis
atgcaagatcctatggaagttta

SEQ ID NO: 1818 - DNA, 26 bp, Chilo suppressalis
atgcaagatcctatggaagtttatgt

SEQ ID NO: 1819 - DNA, 30 bp, Chilo suppressalis
cgctatcagcagttcaaagatttccagaag

SEQ ID NO: 1820 - DNA, 21 bp, Chilo suppressalis
gaaaatgaaaagaataagaag

SEQ ID NO: 1821 - DNA, 23 bp, Chilo suppressalis
gaagttcaacatgaatgtattcc

SEQ ID NO: 1822 - DNA, 23 bp, Chilo suppressalis
gatgagcgtctctcccgctatca

SEQ ID NO: 1823 - DNA, 25 bp, Chilo suppressalis
tgccaattcagaaagatgaagaagt

SEQ ID NO: 1824 - DNA, 22 bp, Chilo suppressalis
tgtaagaaatttatgcaagatc

SEQ ID NO: 1825 - DNA, 21 bp, Chilo suppressalis
aggtgtgcgacgtggacatca

SEQ ID NO: 1826 - DNA, 23 bp, Chilo suppressalis
gacttgaaggagcacatcaggaa

SEQ ID NO: 1827 - DNA, 23 bp, Chilo suppressalis
ggccagaacatccacaactgtga

SEQ ID NO: 1828 - DNA, 21 bp, Chilo suppressalis
tcttgcgagggagagaatcca

SEQ ID NO: 1829 - DNA, 29 bp, Chilo suppressalis
aaaactattgttttccacagaaaaaagaa

SEQ ID NO: 1830 - DNA, 23 bp, Chilo suppressalis
atcaaggacagaaaagtcaaagc

SEQ ID NO: 1831 - DNA, 23 bp, Chilo suppressalis
atctctgccaagtcaaactacaa

SEQ ID NO: 1832 - DNA, 23 bp, Chilo suppressalis
caatgtgccatcatcatgttcga

SEQ ID NO: 1833 - DNA, 26 bp, Chilo suppressalis
cccaactggcacagagatttagtgcg

SEQ ID NO: 1834 - DNA, 31 bp, Chilo suppressalis
gacacttgactggagagttcgagaaaagata

SEQ ID NO: 1835 - DNA, 23 bp, Chilo suppressalis
gatatcaaggacagaaaagtcaa

SEQ ID NO: 1836 - DNA, 23 bp, Chilo suppressalis
gccaagtcaaactacaatttcga

SEQ ID NO: 1837 - DNA, 24 bp, Chilo suppressalis
gctggccaagaaaagtttggtggt

SEQ ID NO: 1838 - DNA, 26 bp, Chilo suppressalis
ggccaagaaaagtttggtggtctccg

SEQ ID NO: 1839 - DNA, 23 bp, Chilo suppressalis
tacaaaaatgtacccaactggca

SEQ ID NO: 1840 - DNA, 29 bp, Chilo suppressalis
tacaaaaatgtacccaactggcacagaga

SEQ ID NO: 1841 - DNA, 23 bp, Chilo suppressalis
tatgggatactgctggccaagaa

SEQ ID NO: 1842 - DNA, 24 bp, Chilo suppressalis
tatgggatactgctggccaagaaa

SEQ ID NO: 1843 - DNA, 21 bp, Chilo suppressalis
tgggatactgctggccaagaa

SEQ ID NO: 1844 - DNA, 23 bp, Chilo suppressalis
tgtgccatcatcatgttcgatgt

SEQ ID NO: 1845 - DNA, 21 bp, Chilo suppressalis
ttgactggagagttcgagaaa

SEQ ID NO: 1846 - DNA, 22 bp, Chilo suppressalis
ttgactggagagttcgagaaaa

SEQ ID NO: 1847 - DNA, 21 bp, Chilo suppressalis
tgggatactgctggccaagaa

SEQ ID NO: 1848 - DNA, 23 bp, Chilo suppressalis
gatcccattcagtctgtcaaggg

SEQ ID NO: 1849 - DNA, 29 bp, Chilo suppressalis
ttccaagcaaagatgttggatatgttgaa

SEQ ID NO: 1850 - DNA, 29 bp, Chilo suppressalis
aaaaagatccaatcttcgaacatgctgaa

SEQ ID NO: 1851 - DNA, 23 bp, Chilo suppressalis
aaacaagtggaactccagaaaaa

SEQ ID NO: 1852 - DNA, 23 bp, Chilo suppressalis
aaagtgcgtgaggaccacgtacg

SEQ ID NO: 1853 - DNA, 23 bp, Chilo suppressalis
aagatcagcaacactctggagtc

SEQ ID NO: 1854 - DNA, 26 bp, Chilo suppressalis
aagatcagcaacactctggagtctcg

SEQ ID NO: 1855 - DNA, 21 bp, Chilo suppressalis
aagatccaatcttcgaacatg

SEQ ID NO: 1856 - DNA, 26 bp, Chilo suppressalis
aagatccaatcttcgaacatgctgaa

SEQ ID NO: 1857 - DNA, 35 bp, Chilo suppressalis
aagcagatcaagcatatgatggccttcatcgaaca

SEQ ID NO: 1858 - DNA, 41 bp, Chilo suppressalis
aagcagatcaagcatatgatggccttcatcgaacaagaggc

SEQ ID NO: 1859 - DNA, 23 bp, Chilo suppressalis
atgatggccttcatcgaacaaga

SEQ ID NO: 1860 - DNA, 26 bp, Chilo suppressalis
atgatggccttcatcgaacaagaggc

SEQ ID NO: 1861 - DNA, 29 bp, Chilo suppressalis
cagatcaagcatatgatggccttcatcga

SEQ ID NO: 1862 - DNA, 29 bp, Chilo suppressalis
cagcagcggctcaagatcatggaatacta

SEQ ID NO: 1863 - DNA, 29 bp, Chilo suppressalis
catatgatggccttcatcgaacaagaggc

SEQ ID NO: 1864 - DNA, 23 bp, Chilo suppressalis
ctcaaagtgcgtgaggaccacgt

SEQ ID NO: 1865 - DNA, 23 bp, Chilo suppressalis
ctcaagatcatggaatactacga

SEQ ID NO: 1866 - DNA, 32 bp, Chilo suppressalis
gaaatcgatgcaaaggccgaagaggagttcaa

SEQ ID NO: 1867 - DNA, 23 bp, Chilo suppressalis
gaactccagaaaaagatccaatc

SEQ ID NO: 1868 - DNA, 38 bp, Chilo suppressalis
gaactccagaaaaagatccaatcttcgaacatgctgaa

SEQ ID NO: 1869 - DNA, 23 bp, Chilo suppressalis
gaggaaatcgatgcaaaggccga

SEQ ID NO: 1870 - DNA, 29 bp, Chilo suppressalis
gccgaagaggagttcaacattgaaaaagg

SEQ ID NO: 1871 - DNA, 21 bp, Chilo suppressalis
gcgcctggctgaggtgcccaa

SEQ ID NO: 1872 - DNA, 23 bp, Chilo suppressalis
ggccgcctggtgcagcagcagcg

SEQ ID NO: 1873 - DNA, 22 bp, Chilo suppressalis
ggctcaagatcatggaatacta

SEQ ID NO: 1874 - DNA, 25 bp, Chilo suppressalis
ggctcaagatcatggaatactacga

SEQ ID NO: 1875 - DNA, 23 bp, Chilo suppressalis
tacgaaaagaaagagaaacaagt

SEQ ID NO: 1876 - DNA, 25 bp, Chilo suppressalis
tgaaggtgctcaaagtgcgtgagga

SEQ ID NO: 1877 - DNA, 46 bp, Chilo suppressalis
ttcaaaagcagatcaagcatatgatggccttcatcgaacaagaggc

SEQ ID NO: 1878 - DNA, 23 bp, Chilo suppressalis
aacgggccggagatcatgtccaa

SEQ ID NO: 1879 - DNA, 23 bp, Chilo suppressalis
aactgccccgatgagaagatccg

SEQ ID NO: 1880 - DNA, 23 bp, Chilo suppressalis
atcttcatcgatgaactggatgc

SEQ ID NO: 1881 - DNA, 23 bp, Chilo suppressalis
catatattgcccattgatgattc

SEQ ID NO: 1882 - DNA, 26 bp, Chilo suppressalis
ctcatgtatgggccgcctggtaccgg

SEQ ID NO: 1883 - DNA, 30 bp, Chilo suppressalis
ctgccccgatgagaagatccgcatgaaccg

SEQ ID NO: 1884 - DNA, 23 bp, Chilo suppressalis
gagaagatccgcatgaaccgcgt

SEQ ID NO: 1885 - DNA, 21 bp, Chilo suppressalis
gtacatatattgcccattgat

SEQ ID NO: 1886 - DNA, 23 bp, Chilo suppressalis
tcatcgcacgtgatcgtaatggc

SEQ ID NO: 1887 - DNA, 21 bp, Chilo suppressalis
ttcatggttcgcgggggcatg

SEQ ID NO: 1888 - DNA, 32 bp, Chilo suppressalis
aaatcggtgtacatgtaacctgggaaaccacg

SEQ ID NO: 1889 - DNA, 22 bp, Chilo suppressalis
aagttgtcctcgtggtcgtcca

SEQ ID NO: 1890 - DNA, 21 bp, Chilo suppressalis
acagatctgggcggcaatttc

SEQ ID NO: 1891 - DNA, 26 bp, Chilo suppressalis
acagccttcatggcctgcacgtcctt

SEQ ID NO: 1892 - DNA, 26 bp, Chilo suppressalis
acatcagagtggtccttgcgggtcat

SEQ ID NO: 1893 - DNA, 26 bp, Chilo suppressalis
accagcacgtgtttctcacactggta

SEQ ID NO: 1894 - DNA, 23 bp, Chilo suppressalis
acctcctcacgggcggcggacac

SEQ ID NO: 1895 - DNA, 29 bp, Chilo suppressalis
acgacagccttcatggcctgcacgtcctt

SEQ ID NO: 1896 - DNA, 26 bp, Chilo suppressalis
acgtagatctgtccctcagtgatgta

SEQ ID NO: 1897 - DNA, 26 bp, Chilo suppressalis
agagcctccgcgtacgaagacatgtc

SEQ ID NO: 1898 - DNA, 21 bp, Chilo suppressalis
agcaatggagttcatcacgtc

SEQ ID NO: 1899 - DNA, 23 bp, Chilo suppressalis
agcagctgccagccgatgtccag

SEQ ID NO: 1900 - DNA, 23 bp, Chilo suppressalis
agcatctccttggggaagatacg

SEQ ID NO: 1901 - DNA, 35 bp, Chilo suppressalis
agggcttcctcaccgacgacagccttcatggcctg

SEQ ID NO: 1902 - DNA, 26 bp, Chilo suppressalis
ataccagtctggatcatttcctcagg

SEQ ID NO: 1903 - DNA, 26 bp, Chilo suppressalis
atacgggaccaggggttgatgggctg

SEQ ID NO: 1904 - DNA, 26 bp, Chilo suppressalis
atagcggagataccagtctggatcat

SEQ ID NO: 1905 - DNA, 23 bp, Chilo suppressalis
atctgggcggcaatttcgttgtg

SEQ ID NO: 1906 - DNA, 21 bp, Chilo suppressalis
atggcagacttcatgagacga

SEQ ID NO: 1907 - DNA, 29 bp, Chilo suppressalis
atggtggccaaatcggtgtacatgtaacc

SEQ ID NO: 1908 - DNA, 30 bp, Chilo suppressalis
atggtggccaaatcggtgtacatgtaacct

SEQ ID NO: 1909 - DNA, 41 bp, Chilo suppressalis
atggtggccaaatcggtgtacatgtaacctgggaaaccacg

SEQ ID NO: 1910 - DNA, 60 bp, Chilo suppressalis
attcaagaacaggcacacgttctccatggagccgttctcctcgaagtcctgcttgaagaa

SEQ ID NO: 1911 - DNA, 29 bp, Chilo suppressalis
attgggggacctttgtcaatgggttttcc

SEQ ID NO: 1912 - DNA, 47 bp, Chilo suppressalis
cacacgttctccatggagccgttctcctcgaagtcctgcttgaagaa

SEQ ID NO: 1913 - DNA, 23 bp, Chilo suppressalis
cactggtaggccaagaactcagc

SEQ ID NO: 1914 - DNA, 21 bp, Chilo suppressalis
catctccttggggaagatacg

SEQ ID NO: 1915 - DNA, 23 bp, Chilo suppressalis
ccctcaccgatggcagacttcat

SEQ ID NO: 1916 - DNA, 23 bp, Chilo suppressalis
ccgatggcagacttcatgagacg

SEQ ID NO: 1917 - DNA, 40 bp, Chilo suppressalis
ccgtctccatgttcacacccatggcggcgaacacgatggc

SEQ ID NO: 1918 - DNA, 29 bp, Chilo suppressalis
ccgttctcctcgaagtcctgcttgaagaa

SEQ ID NO: 1919 - DNA, 31 bp, Chilo suppressalis
ccgttctcctcgaagtcctgcttgaagaacc

SEQ ID NO: 1920 - DNA, 50 bp, Chilo suppressalis
cgagcaatggagttcatcacgtcgatagcggagataccagtctggatcat

SEQ ID NO: 1921 - DNA, 44 bp, Chilo suppressalis
cgggccgtctccatgttcacacccatggcggcgaacacgatggc

SEQ ID NO: 1922 - DNA, 26 bp, Chilo suppressalis
cgtccgggcacctcctcacgggcggc

SEQ ID NO: 1923 - DNA, 32 bp, Chilo suppressalis
cgtccgggcacctcctcacgggcggcggacac

SEQ ID NO: 1924 - DNA, 23 bp, Chilo suppressalis
ctacagatctgggcggcaatttc

SEQ ID NO: 1925 - DNA, 29 bp, Chilo suppressalis
ctacagatctgggcggcaatttcgttgtg

SEQ ID NO: 1926 - DNA, 21 bp, Chilo suppressalis
ctcgtagatggtggccaaatc

SEQ ID NO: 1927 - DNA, 33 bp, Chilo suppressalis
ctcgtagatggtggccaaatcggtgtacatgta

SEQ ID NO: 1928 - DNA, 36 bp, Chilo suppressalis
ctcgtagatggtggccaaatcggtgtacatgtaacc

SEQ ID NO: 1929 - DNA, 48 bp, Chilo suppressalis
ctcgtagatggtggccaaatcggtgtacatgtaacctgggaaaccacg

SEQ ID NO: 1930 - DNA, 24 bp, Chilo suppressalis
gaacaggcacacgttctccatgga

SEQ ID NO: 1931 - DNA, 29 bp, Chilo suppressalis
gactcgaatactgtgcggttctcgtagtt

SEQ ID NO: 1932 - DNA, 35 bp, Chilo suppressalis
gacttcatgagacgagacagggaaggcagcacgtt

SEQ ID NO: 1933 - DNA, 23 bp, Chilo suppressalis
gagataccagtctggatcatttc

SEQ ID NO: 1934 - DNA, 26 bp, Chilo suppressalis
gagataccagtctggatcatttcctc

SEQ ID NO: 1935 - DNA, 23 bp, Chilo suppressalis
gatgaagttcttctcgaacttgg

SEQ ID NO: 1936 - DNA, 24 bp, Chilo suppressalis
gatgaagttcttctcgaacttggt

SEQ ID NO: 1937 - DNA, 44 bp, Chilo suppressalis
gatgaagttcttctcgaacttggtgaggaactcgaggtagagca

SEQ ID NO: 1938 - DNA, 21 bp, Chilo suppressalis
gatggggatctgcgtgatgga

SEQ ID NO: 1939 - DNA, 27 bp, Chilo suppressalis
gcacacgttctccatggagccgttctc

SEQ ID NO: 1940 - DNA, 44 bp, Chilo suppressalis
gccaaatcggtgtacatgtaacctgggaaaccacgtcgtccggg

SEQ ID NO: 1941 - DNA, 22 bp, Chilo suppressalis
gccaagaactcagcagcagtca

SEQ ID NO: 1942 - DNA, 22 bp, Chilo suppressalis
gccgtctccatgttcacaccca

SEQ ID NO: 1943 - DNA, 23 bp, Chilo suppressalis
gccgtctccatgttcacacccat

SEQ ID NO: 1944 - DNA, 29 bp, Chilo suppressalis
gcctgcacgtccttaccgatggcgtagca

SEQ ID NO: 1945 - DNA, 23 bp, Chilo suppressalis
gccttcatggcctgcacgtcctt

SEQ ID NO: 1946 - DNA, 38 bp, Chilo suppressalis
gccttcatggcctgcacgtccttaccgatggcgtagca

SEQ ID NO: 1947 - DNA, 23 bp, Chilo suppressalis
gcggcgaacacgatggcaaagtt

SEQ ID NO: 1948 - DNA, 32 bp, Chilo suppressalis
gcggcgaacacgatggcaaagttgtcctcgtg

SEQ ID NO: 1949 - DNA, 23 bp, Chilo suppressalis
gcgtacagctggttggaaacatc

SEQ ID NO: 1950 - DNA, 35 bp, Chilo suppressalis; identical to SEQ ID NO: 409

SEQ ID NO: 1951 - DNA, 37 bp, Chilo suppressalis; identical to SEQ ID NO: 410

SEQ ID NO: 1952 - DNA, 26 bp, Chilo suppressalis
ggatgggtgatgtcgtcgttgggcat

SEQ ID NO: 1953 - DNA, 32 bp, Chilo suppressalis
ggcagaccggcagccgagaaaatggggatctt

SEQ ID NO: 1954 - DNA, 23 bp, Chilo suppressalis
ggcatagtcaagatggggatctg

SEQ ID NO: 1955 - DNA, 27 bp, Chilo suppressalis
ggccgtctccatgttcacacccatggc

SEQ ID NO: 1956 - DNA, 23 bp, Chilo suppressalis
ggcgggtagatctgtctgttgtg

SEQ ID NO: 1957 - DNA, 56 bp, Chilo suppressalis
ggcgggtagatctgtctgttgtggagctgacggtctacgtagatctgtccctcagt

SEQ ID NO: 1958 - DNA, 23 bp, Chilo suppressalis
gggaagatacggagcagctgcca

SEQ ID NO: 1959 - DNA, 29 bp, Chilo suppressalis
gggttgatgggctgtccctggatgtccaa

SEQ ID NO: 1960 - DNA, 23 bp, Chilo suppressalis
ggttttccagagccgttgaatac

SEQ ID NO: 1961 - DNA, 26 bp, Chilo suppressalis
gtgatgaagttcttctcgaacttggt

SEQ ID NO: 1962 - DNA, 23 bp, Chilo suppressalis
gtgcggttctcgtagttgccctg

SEQ ID NO: 1963 - DNA, 26 bp, Chilo suppressalis
gtggccaaatcggtgtacatgtaacc

SEQ ID NO: 1964 - DNA, 26 bp, Chilo suppressalis
gtgtacatgtaacctgggaaaccacg

SEQ ID NO: 1965 - DNA, 29 bp, Chilo suppressalis
gtgtacatgtaacctgggaaaccacgtcg

SEQ ID NO: 1966 - DNA, 53 bp, Chilo suppressalis
gtgtacatgtaacctgggaaaccacgtcgtccgggcacctcctcacgggcggc

SEQ ID NO: 1967 - DNA, 23 bp, Chilo suppressalis
tcagagtggtccttgcgggtcat

SEQ ID NO: 1968 - DNA, 26 bp, Chilo suppressalis
tcagcaaggattgggggacctttgtc

SEQ ID NO: 1969 - DNA, 29 bp, Chilo suppressalis
tcctcaccgacgacagccttcatggcctg

SEQ ID NO: 1970 - DNA, 23 bp, Chilo suppressalis
tcctcagggtagatacgggacca

SEQ ID NO: 1971 - DNA, 38 bp, Chilo suppressalis
tcctcagggtagatacgggaccaggggttgatgggctg

SEQ ID NO: 1972 - DNA, 22 bp, Chilo suppressalis
tcgaagtcctgcttgaagaacc

SEQ ID NO: 1973 - DNA, 35 bp, Chilo suppressalis
tcgtagatggtggccaaatcggtgtacatgtaacc

SEQ ID NO: 1974 - DNA, 47 bp, Chilo suppressalis
tcgtagatggtggccaaatcggtgtacatgtaacctgggaaaccacg

SEQ ID NO: 1975 - DNA, 29 bp, Chilo suppressalis
tctacgtagatctgtccctcagtgatgta

SEQ ID NO: 1976 - DNA, 26 bp, Chilo suppressalis
tgcacgtccttaccgatggcgtagca

SEQ ID NO: 1977 - DNA, 23 bp, Chilo suppressalis
tgggtgatgtcgtcgttgggcat

SEQ ID NO: 1978 - DNA, 23 bp, Chilo suppressalis
tggtaggccaagaactcagcagc

SEQ ID NO: 1979 - DNA, 26 bp, Chilo suppressalis
ttcaagaacaggcacacgttctccat

SEQ ID NO: 1980 - DNA, 29 bp, Chilo suppressalis
ttcaagaacaggcacacgttctccatgga

SEQ ID NO: 1981 - DNA, 23 bp, Chilo suppressalis
ttctcacactggtaggccaagaa

SEQ ID NO: 1982 - DNA, 26 bp, Chilo suppressalis
ttctcctcgaagtcctgcttgaagaa

SEQ ID NO: 1983 - DNA, 26 bp, Chilo suppressalis
ttgagcatctccttggggaagatacg

SEQ ID NO: 1984 - DNA, 31 bp, Chilo suppressalis
ttgagcatctccttggggaagatacggagca

SEQ ID NO: 1985 - DNA, 38 bp, Chilo suppressalis
ttgagcatctccttggggaagatacggagcagctgcca

SEQ ID NO: 1986 - DNA, 47 bp, Chilo suppressalis
ttgagcatctccttggggaagatacggagcagctgccagccgatgtc

SEQ ID NO: 1987 - DNA, 21 bp, Chilo suppressalis
tccgactactcttccacggac

SEQ ID NO: 1988 - DNA, 21 bp, Chilo suppressalis
atacaagctgtgcaaggtgcg

SEQ ID NO: 1989 - DNA, 23 bp, Chilo suppressalis
aagcacattgacttctcgctgaa

SEQ ID NO: 1990 - DNA, 21 bp, Chilo suppressalis
cgcaacaagcgtgaggtgtgg

SEQ ID NO: 1991 - DNA, 24 bp, Chilo suppressalis
cgtctccagactcaggtgttcaag

SEQ ID NO: 1992 - DNA, 23 bp, Chilo suppressalis
tttaatgtatgggatactgctgg

SEQ ID NO: 1993 - DNA, 25 bp, Chilo suppressalis
cacttgactggagagttcgagaaaa

SEQ ID NO: 1994 - DNA, 25 bp, Chilo suppressalis
ctcgtgtcacctacaaaaatgtacc

SEQ ID NO: 1995 - DNA, 23 bp, Chilo suppressalis
cacttgactggagagttcgagaa

SEQ ID NO: 1996 - DNA, 22 bp, Chilo suppressalis
taggtgaatttgttgatgatta

SEQ ID NO: 1997 - DNA, 23 bp, Chilo suppressalis
aagaaagagaaacaagtggaact

SEQ ID NO: 1998 - DNA, 26 bp, Chilo suppressalis
gtgtacatgtaacctgggaaaccacg

SEQ ID NO: 1999 - DNA, 23 bp, Chilo suppressalis
gtgtacatgtaacctgggaaacc

SEQ ID NO: 2000 - DNA, 23 bp, Chilo suppressalis
gccaaatcggtgtacatgtaacc

SEQ ID NO: 2001 - DNA, 29 bp, Chilo suppressalis
aagttcttctcgaacttggtgaggaactc

SEQ ID NO: 2002 - DNA, 21 bp, Chilo suppressalis
tggtctccgcaacaagcgtga

SEQ ID NO: 2003 - DNA, 21 bp, Chilo suppressalis
ggtctccgcaacaagcgtgag

SEQ ID NO: 2004 - DNA, 24 bp, Chilo suppressalis
tggtctccgcaacaagcgtgaggt

SEQ ID NO: 2005 - DNA, 24 bp, Chilo suppressalis
tggtctccgcaacaagcgtgaggt

SEQ ID NO: 2006 - DNA, 23 bp, Chilo suppressalis
ggtctccgcaacaagcgtgaggt

SEQ ID NO: 2007 - DNA, 28 bp, Chilo suppressalis
tggtctccgcaacaagcgtgaggtgtgg

SEQ ID NO: 2008 - DNA, 21 bp, Chilo suppressalis
cgcaacaagcgtgaggtgtgg

SEQ ID NO: 2009 - DNA, 23 bp, Chilo suppressalis
tcccctctcgtatgacaattggt

SEQ ID NO: 2010 - DNA, 21 bp, Chilo suppressalis
atttagctttgacaaagaata

SEQ ID NO: 2011 - DNA, 23 bp, Chilo suppressalis
gagcacccttcagaagttcaaca

SEQ ID NO: 2012 - DNA, 21 bp, Chilo suppressalis
tgggatactgctggccaagaa

SEQ ID NO: 2013 - DNA, 29 bp, Chilo suppressalis
aagtttggtggtctccgagatggttacta

SEQ ID NO: 2014 - DNA, 23 bp, Chilo suppressalis
caatgtgccatcatcatgttcga

SEQ ID NO: 2015 - DNA, 21 bp, Chilo suppressalis
catcatcatgttcgatgtaac

SEQ ID NO: 2016 - DNA, 23 bp, Chilo suppressalis
cacttgactggagagttcgagaa

SEQ ID NO: 2017 - DNA, 23 bp, Chilo suppressalis
tgaaggttcttttttctgtggaa

SEQ ID NO: 2018 - DNA, 23 bp, Chilo suppressalis
ggatggtaccactcgcatcctgg

SEQ ID NO: 2019 - DNA, 21 bp, Chilo suppressalis
aacgagaggaagaagaagaag

SEQ ID NO: 2020 - DNA, 22 bp, Chilo suppressalis
agggcttcttcttcttcctctc

SEQ ID NO: 2021 - DNA, 21 bp, Chilo suppressalis
tagggcttcttcttcttcctc

SEQ ID NO: 2022 - DNA, 21 bp, Chilo suppressalis
gagatggtcgagttgcctcta

SEQ ID NO: 2023 - DNA, 21 bp, Chilo suppressalis
gctgaagactttttggacatc

SEQ ID NO: 2024 - DNA, 25 bp, Chilo suppressalis
cctcaccaagttcgagaagaacttc

SEQ ID NO: 2025 - DNA, 21 bp, Chilo suppressalis
gtcgtcggtgaggaagccctg

SEQ ID NO: 2026 - DNA, 27 bp, Chilo suppressalis
tcctcaccgacgacagccttcatggcc

SEQ ID NO: 2027 - DNA, 24 bp, Chilo suppressalis
gatgtttccaaccagctgtacgcc

SEQ ID NO: 2028 - DNA, 24 bp, Chilo suppressalis
ggcgtacagctggttggaaacatc

SEQ ID NO: 2029 - DNA, 25 bp, Chilo suppressalis
tgatgtttccaaccagctgtacgcc

SEQ ID NO: 2030 - DNA, 23 bp, Chilo suppressalis
atggcagacttcatgagacgaga

SEQ ID NO: 2031 - DNA, 23 bp, Chilo suppressalis
atgcccaacgacgacatcaccca

SEQ ID NO: 2032 - DNA, 23 bp, Chilo suppressalis
tgggtgatgtcgtcgttgggcat

SEQ ID NO: 2033 - DNA, 23 bp, Chilo suppressalis
actatgcccaacgacgacatcac

SEQ ID NO: 2034 - DNA, 21 bp, Chilo suppressalis
ggttacatgtacaccgatttg

SEQ ID NO: 2035 - DNA, 24 bp, Chilo suppressalis
cccaggttacatgtacaccgattt

SEQ ID NO: 2036 - DNA, 21 bp, Chilo suppressalis
acaccacgtttggccttgact

SEQ ID NO: 2037 - DNA, 23 bp, Chilo suppressalis
gccatgggtgtgaacatggagac

SEQ ID NO: 2038 - DNA, 34 bp, Chilo suppressalis
gacgaccacgaggacaactttgccatcgtgttcg

SEQ ID NO: 2039 - DNA, 23 bp, Chilo suppressalis
aagatccccattttctcggctgc

SEQ ID NO: 2040 - DNA, 697 bp, Chilo suppressalis
taaagcatggatgttggacaaactgggtggcgtgtacgcgccgcggccgtcgaccggcccccacaagttgcgcgagtgcctgccgctggtgatcttcctcaggaaccggctcaagtacgcgctcaccggaaatgaagtgcttaagattgtaaagcagcgacttatcaaagttgacggcaaagtcaggacagaccccacatatcccgctggatttatggatgttgtttccattgaaaagacaaatgagctgttccgtcttatatatgatgtcaaaggcagatttactattcaccgtattactcctgaggaggctaaatacaagctgtgcaaggtgcggcgcgtggcgacgggccccaagaacgtgccttacctggtgacccacgacggacgcaccgtgcgataccccgacccactcatcaaggtcaacgactccatccagctcgacatcgccacctccaagatcatggacttcatcaagtttgaatctggtaacctatgtatgatcacgggaggccgtaacttggggcgcgtgggcaccatcgtgtcccgcgagcgacatcccgggtccttcgacatcgtgcatatacgggactccaccggacataccttcgctaccagattgaacaacgtgttcataatcggcaagggcacgaaggcgtacatctcgctgccgcgcggcaagggcgtgcgactcacc

SEQ ID NO: 2041 - DNA, 27 bp, Artificial sequence
  Primer sequence
taaagcatggatgttggacaaactggg

SEQ ID NO: 2042 - DNA, 43 bp, Artificial sequence
  Primer sequence
gcgtaatacgactcactataggggtgagtcgcacgcccttgcc

SEQ ID NO: 2043 - DNA, 49 bp, Artificial sequence
  Primer sequence
gcgtaatacgactcactataggtaaagcatggatgttggacaaactggg

SEQ ID NO: 2044 - DNA, 21 bp, Artificial sequence
  Primer sequence
ggtgagtcgcacgcccttgcc

SEQ ID NO: 2045 - DNA, 343 bp, Chilo suppressalis
caagaaggaggagaagggtccatcaacacacgaagctatacagaaattacgcgaaacggaagagttattgcagaagaaacaagagtttctagagcgaaagatcgacactgaattacaaacggcgagaaaacatggcacaaagaataagagagctgccattgcggcactgaagcgcaagaagcgttatgaaaagcagcttacccagattgatggcacgcttacccaaattgaggcccaaagggaagcgctagaaggagctaacaccaatacacaggtgcttaacactatgcgagatgctgctaccgctatgagactcgcccacaaggatatcgatgtagacaag

SEQ ID NO: 2046 - DNA, 27 bp, Artificial sequence
  Primer sequence
caagaaggaggagaagggtccatcaac

SEQ ID NO: 2047 - DNA, 49 bp, Artificial sequence
  Primer sequence
gcgtaatacgactcactataggcttgtctacatcgatatccttgtgggc

SEQ ID NO: 2048 - DNA, 49 bp, Artificial sequence
  Primer sequence
gcgtaatacgactcactataggcaagaaggaggagaagggtccatcaac

SEQ ID NO: 2049 - DNA, 27 bp, Artificial sequence
  Primer sequence
cttgtctacatcgatatccttgtgggc

SEQ ID NO: 2050 - DNA, 392 bp, Chilo suppressalis
tggtctccgcaacaagcgtgaggtgtggagggtgaagtacacgctggccaggatccgtaaggctgcccgtgagctgctcacactcgaggagaaagaccctaagaggttattcgaaggtaatgctctccttcgtcgtctggtgaggatcggtgtgttggatgagaagcagatgaagctcgattatgtactcggtctgaagattgaggacttcttggaacgtcgtctccagactcaggtgttcaaggctggtctagctaagtctatccatcatgcccgtattcttatcagacagaggcacatccgtgtccgcaagcaagttgtgaacatcccttcgttcatcgtgcggctggactctggcaagcacattgacttctcgctgaagtctccgttcg

SEQ ID NO: 2051 - DNA, 23 bp, Artificial sequence
  Primer sequence
tggtctccgcaacaagcgtgagg

SEQ ID NO: 2052 - DNA, 48 bp, Artificial sequence
  Primer sequence
gcgtaatacgactcactataggcgaacggagacttcagcgagaagtca

SEQ ID NO: 2053 - DNA, 45 bp, Artificial sequence
  Primer sequence
gcgtaatacgactcactataggtggtctccgcaacaagcgtgagg

SEQ ID NO: 2054 - DNA, 26 bp, Artificial sequence
  Primer sequence
cgaacggagacttcagcgagaagtca

SEQ ID NO: 2055 - DNA, 467 bp, Chilo suppressalis
ggatgatgatggtataattgcaccagggattcgtgtatctggtgacgatgtagtcattggaaaaactataactttgccagaaaacgatgatgagctggaaggaacatcaagacgatacagtaagagagatgcctctacattcttgcgaaacagtgaaactggtattgttgaccaagttatgcttacacttaacagcgaaggatacaaattttgtaaaatacgtgtgagatctgtgagaatcccacaaattggagacaaatttgcttctcgtcatggtcaaaaagggacttgtggtattcaatataggcaagaagatatgcctttcacttgtgaaggattgacaccagatattatcatcaatccacatgctatcccctctcgtatgacaattggtcacttgattgaatgtattcaaggtaaggtctcctcaaataaaggtgaaataggtgatgctacaccatttaacg

SEQ ID NO: 2056 - DNA, 28 bp, Artificial sequence
  Primer sequence
ggatgatgatggtataattgcaccaggg

SEQ ID NO: 2057 - DNA, 53 bp, Artificial sequence
  Primer sequence
gcgtaatacgactcactataggcgttaaatggtgtagcatcacctatttcacc

SEQ ID NO: 2058 - DNA, 50 bp, Artificial sequence
  Primer sequence
gcgtaatacgactcactataggggatgatgatggtataattgcaccaggg

SEQ ID NO: 2059 - DNA, 31 bp, Artificial sequence
  Primer sequence
cgttaaatggtgtagcatcacctatttcacc

SEQ ID NO: 2060 - DNA, 928 bp, Chilo suppressalis
cttgttgaaaccagagattttgagggctatcgtcgattgcggtttcgagcacccttcagaagttcaacatgaatgtattccccaagctgttttgggaatggatattctttgtcaaagctaaatccggaatgggaaaaaccgccgtatttgttttagcaacactgcaacagctagaaccttcagaaaaccatgtttacgtattagtaatgtgccatacaagggaactcgctttccaaataagcaaggaatatgagaggttctctaaatatatggctggtgttagagtatctgtattctttggtgggatgccaattcagaaagatgaagaagtattgaagacagcctgcccgcacatcgttgttggtactcctggcagaatattagcattggttaacaacaagaaactgaatttaaaacacctgaaacacttcatcctggatgaatgtgacaaaatgcttgaatctctagacatgagacgtgatgtgcaggaaatattcaggaacacccctcacggtaagcaggtcatgatgttttctgcaacattgagtaaggagatcagaccagtctgtaagaaatttatgcaagatcctatggaagtttatgtggatgatgaagctaaacttacattgcacggtttgcagcaacattatgttaaactcaaggaaaatgaaaagaataagaagttatttgaacttttggatgtactggagttcaaccaagttgtcatatttgtaaagtcagtgcagcgctgcatagctctcgcacagctgctgacagaccaaaacttcccagctattggtatacaccgaaatatgactcaagatgagcgtctctcccgctatcagcagttcaaagatttccagaagaggatccttgttgcgacaaatctttttggacggggtatggacattgaaagagtcaacatagt

SEQ ID NO: 2061 - DNA, 27 bp, Artificial sequence
  Primer sequence
cttgttgaaaccagagattttgagggc

SEQ ID NO: 2062 - DNA, 54 bp, Artificial sequence
  Primer sequence
gcgtaatacgactcactataggcggcatgtcataattgaagactatgttgactc

SEQ ID NO: 2063 - DNA, 49 bp, Artificial sequence
  Primer sequence
gcgtaatacgactcactataggcttgttgaaaccagagattttgagggc

SEQ ID NO: 2064 - DNA, 32 bp, Artificial sequence
  Primer sequence
cggcatgtcataattgaagactatgttgactc

SEQ ID NO: 2065 - DNA, 481 bp, Chilo suppressalis
acgtttctgcagcggctggactcacgggagcccatgtggcagctggacgagagcatcatcggcaccaaccccgggctcggcttccggcccacgccgccagaggtcgccagcagcgtcatctggtataaaggcaacgaccccaacagccaacaattctgggtgcaagaaacctccaactttctaaccgcgtacaaacgagacggtaagaaagcaggagcaggccagaacatccacaactgtgatttcaaactgcctcctccggccggtaaggtgtgcgacgtggacatcagcgcctggagtccctgtgtagaggacaagcactttggataccacaagtccacgccctgcatcttcctcaaactcaacaagatcttcggctggaggccgcacttctacaacagctccgacagcctgcccactgacatgcccgacgacttgaaggagcacatcaggaatatgacagcgtacgataagaattatc

SEQ ID NO: 2066 - DNA, 23 bp, Artificial sequence
  Primer sequence
acgtttctgcagcggctggactc

SEQ ID NO: 2067 - DNA, 54 bp, Artificial sequence
  Primer sequence
gcgtaatacgactcactatagggataattcttatcgtacgctgtcatattcctg

SEQ ID NO: 2068 - DNA, 45 bp, Artificial sequence
  Primer sequence
gcgtaatacgactcactataggacgtttctgcagcggctggactc

SEQ ID NO: 2069 - DNA, 32 bp, Artificial sequence
  Primer sequence
gataattcttatcgtacgctgtcatattcctg

SEQ ID NO: 2070 - DNA, 441 bp, Chilo suppressalis
cgacacttgactggagagttcgagaaaagatatgtcgccacattaggtgtcgaggtgcatcccttagtattccacacaaatagaggccctataaggtttaatgtatgggatactgctggccaagaaaagtttggtggtctccgagatggttactatatccaaggtcaatgtgccatcatcatgttcgatgtaacgtctcgtgtcacctacaaaaatgtacccaactggcacagagatttagtgcgagtctgtgaaggcattccaattgttctttgtggcaacaaagtagatatcaaggacagaaaagtcaaagcaaaaactattgttttccacagaaaaaagaaccttcagtattatgacatctctgccaagtcaaactacaatttcgagaaacccttcctctggttagcgagaaagttgatcggtgatggtaacctagag

SEQ ID NO: 2071 - DNA, 25 bp, Artificial sequence
  Primer sequence
cgacacttgactggagagttcgaga

SEQ ID NO: 2072 - DNA, 48 bp, Artificial sequence
  Primer sequence
gcgtaatacgactcactataggctctaggttaccatcaccgatcaact

SEQ ID NO: 2073 - DNA, 47 bp, Artificial sequence
  Primer sequence
gcgtaatacgactcactataggcgacacttgactggagagttcgaga

SEQ ID NO: 2074 - DNA, 26 bp, Artificial sequence
  Primer sequence
ctctaggttaccatcaccgatcaact

SEQ ID NO: 2075 - DNA, 353 bp, Chilo suppressalis
tgccgaacaggtatacatctcgtctttggccctgttgaagatgttaaaacacgggcgcgccggtgttccaatggaagttatgggacttatgttaggtgaatttgttgatgattacacggtgcgtgtcatagacgtatttgccatgcctcaaactggcacaggagtgtcggttgaagctgtagatcctgtcttccaagcaaagatgttggatatgttgaagcaaactggacgacctgagatggtagtgggatggtaccactcgcatcctggctttggatgttggttatctggagtcgacattaatactcagcagtctttcgaagctttgtctgaacgtgctgtagctgtagtgg

SEQ ID NO: 2076 - DNA, 29 bp, Artificial sequence
  Primer sequence
tgccgaacaggtatacatctcgtctttgg

SEQ ID NO: 2077 - DNA, 48 bp, Artificial sequence
  Primer sequence
gcgtaatacgactcactataggccactacagctacagcacgttcagac

SEQ ID NO: 2078 - DNA, 51 bp, Artificial sequence
  Primer sequence
gcgtaatacgactcactataggtgccgaacaggtatacatctcgtctttgg

SEQ ID NO: 2079 - DNA, 26 bp, Artificial sequence
  Primer sequence
ccactacagctacagcacgttcagac

SEQ ID NO: 2080 - DNA, 617 bp, Chilo suppressalis
agatcaagcatatgatggccttcatcgaacaagaggctaatgaaaaggccgaggaaatcgatgcaaaggccgaagaggagttcaacattgaaaaaggccgcctggtgcagcagcagcggctcaagatcatggaatactacgaaaagaaagagaaacaagtggaactccagaaaaagatccaatcttcgaacatgctgaatcaagcccgtctgaaggtgctcaaagtgcgtgaggaccacgtacgcaacgttctcgacgaggctcgcaagcgcctggctgaggtgcccaaagacgtgaaactttacacagatctgctggtcacgctcgtcgtacaagccctattccagctcatggaacccacagtaacagttcgcgttaggcaggcggacgtctccttagtacagtccatattgggcaaggcacagcaggattacaaagcaaagatcaagaaggacgttcaattgaagatcgacaccgagaattccctgcccgccgatacttgtggcggagtggaacttattgctgctagagggcgtattaagatcagcaacactctggagtctcgtctggagctgatagcccaacaactgttgcccgaaatacgtaccgcattgttc

SEQ ID NO: 2081 - DNA, 29 bp, Artificial sequence
  Primer sequence
cagatcaagcatatgatggccttcatcga

SEQ ID NO: 2082 - DNA, 47 bp, Artificial sequence
  Primer sequence
gcgtaatacgactcactatagggaacaatgcggtacgtatttcgggc

SEQ ID NO: 2083 - DNA, 51 bp, Artificial sequence
  Primer sequence
gcgtaatacgactcactataggcagatcaagcatatgatggccttcatcga

SEQ ID NO: 2084 - DNA, 25 bp, Artificial sequence
  Primer sequence
gaacaatgcggtacgtatttcgggc

SEQ ID NO: 2085 - DNA, 826 bp, Chilo suppressalis
atcgtgctttcagacgataactgccccgatgagaagatccgcatgaaccgcgtcgtgcgaaacaacttgcgtgtacgcctgtcagacatagtctccatagcgccttgtccatcggtcaaatatgggaaacgggtacatatattgcccattgatgattctgtcgagggtttgactggaaatttattcgaagtctacttgaaaccatacttcatggaagcttatcggcctatccatcgcgatgacacattcatggttcgcgggggcatgagggctgttgaattcaaagtggtggagactgatccgtcgccgtattgcatcgtcgctcccgacacagtgatacactgcgaaggagaccctatcaaacgagaggaagaagaagaagccctaaacgccgtagggtacgacgacatcggtggctgtcgtaaacagctcgctcagatcaaagagatggtcgagttgcctctaaggcatccgtcgctgttcaaggcaattggtgtgaagccgccacgtggaatcctcatgtatgggccgcctggtaccggcaaaactctcattgctcgggcagtggctaatgaaactggtgcattcttctttctgatcaacgggccggagatcatgtccaaactcgcgggcgagtccgaatcgaaccttcgcaaggcattcgaggaagcggacaagaactccccggctataatcttcatcgatgaactggatgccatcgcaccaaagagggagaagactcacggtgaagtggagcgtcgtattgtgtcgcaactacttactcttatggatggaatgaagaagtcatcgcacgtgatcgtaatgg

SEQ ID NO: 2086 - DNA, 27 bp, Artificial sequence
  Primer sequence
atcgtgctttcagacgataactgcccc

SEQ ID NO: 2087 - DNA, 48 bp, Artificial sequence
  Primer sequence
gcgtaatacgactcactataggccattacgatcacgtgcgatgacttc

SEQ ID NO: 2088 - DNA, 49 bp, Artificial sequence
  Primer sequence
gcgtaatacgactcactataggatcgtgctttcagacgataactgcccc

SEQ ID NO: 2089 - DNA, 26 bp, Artificial sequence
  Primer sequence
ccattacgatcacgtgcgatgacttc

SEQ ID NO: 2090 - DNA, 1144 bp, Chilo suppressalis; identical to SEQ ID NO: 1702

SEQ ID NO: 2091 - DNA, 26 bp, Artificial sequence
  Primer sequence
aggatggaagcggggatacgtttgag

SEQ ID NO: 2092 - DNA, 47 bp, Artificial sequence
  Primer sequence
gcgtaatacgactcactatagggcacccctgtctccgaagacatgtt

SEQ ID NO: 2093 - DNA, 48 bp, Artificial sequence
  Primer sequence
gcgtaatacgactcactataggaggatggaagcggggatacgtttgag

SEQ ID NO: 2094 - DNA, 25 bp, Artificial sequence
  Primer sequence
gcacccctgtctccgaagacatgtt

SEQ ID NO: 2095 - DNA, 1153 bp, Chilo suppressalis
cgtccctgtacctgctcagcaatcccaacagcagcagagttaccgccacgtcagcgagagcgtcgaacacaaatcctacggcacgcaagggtacaccacttcggaacagaccaagcagacacagaaggtggcgtacaccaacggttccgactactcttccacggacgactttaaggtggatacgttcgaatacagactcctccgagaagtttcgttcagggaatccatcacgaagcggtacattggcgagacagacattcagatcagcacggaggtcgacaagtctctcggtgtggtgacccctcctaagatagcacaaaagcctaggaattccaagctgcaggagggagccgacgctcagtttcaagtgcagctgtcgggtaacccgcggccacgggtgtcatggttcaagaacgggcagaggatagtcaactcgaacaaacacgaaatcgtcacgacacataatcaaacaatacttagggtaagaaacacacaaaagtctgatactggcaactacacgttgttggctgaaaatcctaacggatgcgtcgtcacatcggcatacctggccgtggagtcgcctcaagaaacttacggccaagatcataaatcacaatacataatggacaatcagcaaacagctgtagaagaaagagtagaagttaatgaaaaagctctcgctccgcaattcgtaagagtctgccaagaccgcgatgtaacggaggggaaaatgacgcgattcgattgccgcgtcacgggcagaccttacccagaagtcacgtggttcattaacgatagacaaattcgagacgattatwatcataagatattagtaaacgaatcgtgtaatcatgcacttatgattacaaacgtcgatctcagtgatagtggcgtagtatcatgtatagcacgcaacaagaccggcgaaacttcgtttcagtgtaggctgaacgtgatagagaaggagcaagtggtcgctcccaaattcgtggagcggttcagcacgctcaacgtgcgcgagggcgagcccgtgcagctgcacgcgcgcgccgtcggcacgcctacgccacgcatcacatggcagaaggacggcgttcaagttatacccaatccagagctacgaataaataccgaaggtggggcctcgacgctg

SEQ ID NO: 2096 - DNA, 27 bp, Artificial sequence
  Primer sequence
cgtccctgtacctgctcagcaatccca

SEQ ID NO: 2097 - DNA, 42 bp, Artificial sequence
  Primer sequence
gcgtaatacgactcactataggcagcgtcgaggccccacctt

SEQ ID NO: 2098 - DNA, 49 bp, Artificial sequence
  Primer sequence
gcgtaatacgactcactataggcgtccctgtacctgctcagcaatccca

SEQ ID NO: 2099 - DNA, 20 bp, Artificial sequence
  Primer sequence
cagcgtcgaggccccacctt

SEQ ID NO: 2100 - DNA, 688 bp, ;Plutella xylostella
ggccccaagaagcatttgaagcgcctgaacgcgccgcgcgcatggatgctggacaagctcggcggcgtgtacgcgccgcggcccagcacgggcccgcacaagctgcgcgagtgcctgccgctcgtcatcttcctgcaaccgcctcaagtacgcgctcagcggcaacgaggtgctgaagatcgtgaagcagcgcctcatcaaggtggacggcaaggtccgcaccgaccccacctacccggctggattcatggatgttgtgtcgattgaaaagaccaatgagctgttccgtctgatctacgatgtgaagggacgcttcaccatccaccgcatcactcccgaggaggccaagtacaagctgtgcaaggtgaagcgcgtggcgacgggccccaagaacgtgccgtacatcgtgacgcacaacggccgcacgctgcgctaccccgacccgctcatcaaggtcaacgactccatccagctcgacatcgccacctgcaagatcatggacatcatcaagttcgactcaggtaacctgtgcatgatcacgggagggcgtaacttggggcgagtgggcaccatcgtgtcccgcgagaggcaccccgggagcttcgacatcgtccacatcaaggacaccaccggacacaccttcgccaccaggttgaacaacgtgttcatcatcggcaagggcacgaag

SEQ ID NO: 2101 - protein, 225 aa, Plutella xylostella
GPKKHLKRLNAPRAWMLDKLGGVYAPRPSTGPHKLRECLPLVIFLQPPQVRAQRQRGAEDREAAPHQGGRQGPHRPHLPGWIHGCCVDKDQAVPSDLRCEGTLHHPPHHSRGGQVQAVQGEARGDGPQERAVHRDAQRPHAALPRPAHQGQRLHPARHRHLQDHGHHQVRLRPVHDHGRALGASGHHRVPREAPRELRHRPHQGHHRTHLRHQVEQRVHHRQGHE

SEQ ID NO: 2102 - DNA, 580 bp, ;Plutella xylostella
gcacgttgatctggtacaaaggaaccggttacgacagctacaagtattgggagaaccagctcattgactttttgtcagtatacaagaagaagggtcagacagcgggtgctggtcagaacatcttcaactgtgacttccgcaacccgcccccacacggcaaggtgtgcgacgtggacatccgcggctgggagccctgcattgatgagaaccacttctctttccacaagtcttcgccttgcatcttcttgaagctgaataagatctacggctggcgtccagagttctacaacgacacggctaacctgcctgaagccatgcccgtggacttgcagacccacattcgtaacattactgccttcaacagagactatgcgaacatggtgtgggtgtcgtgccacggcgagacgccggcggacaaggagaacatcgggccggtgcgctacctgccctacccgggcttccccgggtacttctacccgtacgagaacgccgaggggtatctgagcccgctggtcgccgtgcatttggagaggccgaggaccggcatagtgatcaacatcgagtgcaaagcgtgggctgc

SEQ ID NO: 2103 - protein, 192 aa, Plutella xylostella
TLIWYKGTGYDSYKYWENQLIDFLSVYKKKGQTAGAGQNIFNCDFRNPPPHGKVCDVDIRGWEPCIDENHFSFHKSSPCIFLKLNKIYGWRPEFYNDTANLPEAMPVDLQTHIRNITAFNRDYANMVWVSCHGETPADKENIGPVRYLPYPGFPGYFYPYENAEGYLSPLVAVHLERPRTGIVINIECKAWA

SEQ ID NO: 2104 - DNA, 865 bp, ;Plutella xylostella
gtggctgcatacagttcattacgcagtaccagcactctagtggacaacgtcgcgttcgggtcaccactgtcgcgcgcaattggggcgacgcagccgccaacttacaccacatatcggcgggcttcgaccaggaggcggcggcggtggtgatggcgcggctggtggtgtaccgcgcggagcaggaggacgggcccgacgtgctgcgctggctcgaccgcatgctcatacgcctgtgccagaagttcggcgagtacgcgaaggacgacccgaacagcttccgtctgtcggagaacttcagcctgtacccgcagttcatgtaccacctgcgccgctcgcagttcctgcaggtcttcaacaactcgcccgacgagaccaccttctacagacacatgctgatgcgcgaagacctgacccaatccctcatcatgatccagccgatcctctactcgtacagcttcggaggcgcgcccgaacccgtgctgttagacaccagctccatccagcccgaccgcatcctgctcatggacaccttcttccagatcctcatctaccatggagagacaatggcgcaatggcgcgctctccgctaccaagacatggctgagtacgagaacttcaagcagctgctgcgagcgcccgtggacgacgcgcaggagatcctgcagaccaggttccccgtgccgcggtacattgatacagagcacggcggctcacaggcccggttcttgctttccaaagtgaatccctctcagactcacaacaacatgtacgcgtatggcggggcgatgccgataccatcagcggacggtggcgcccccgtgttgacggatgacgtgtcgctgcaagtgttcatggagcagccgcg

SEQ ID NO: 2105 - protein, 287 aa, Plutella xylostella
GCIQFITQYQHSSGQRRVRVTTVARNWGDAAANLHHISAGFDQEAAAVVMARLVVYRAEQEDGPDVLRWLDRMLIRLCQKFGEYAKDDPNSFRLSENFSLYPQFMYHLRRSQFLQVFNNSPDETTFYRHMLMREDLTQSLIMIQPILYSYSFGGAPEPVLLDTSSIQPDRILLMDTFFQILIYHGETMAQWRALRYQDMAEYENFKQLLRAPVDDAQEILQTRFPVPRYIDTEHGGSQARFLLSKVNPSQTHNNMYAYGGAMPIPSADGGAPVLTDDVSLQVFMEQP

SEQ ID NO: 2106 - DNA, 742 bp, ;Plutella xylostella
gccgcaaggagaccgtgtgcattgtgctgtccgacgacaactgccccgacgagaagatccgcatgaaccgcgtcgtccggaacaacctgcgagtgcgcctgtcagacattgtgtccatcgctccttgcccgtcagtgaagtacggcaagagagttcatattctgcccattgatgactctgttgagggtttgactggaaacctgttcgaagtctacctgaagccgtacttcatggaggcgtaccggcccatccaccgcgacgacacgttcatggtgcgcggcggcatgcgcgccgtcgagttcaaggtggtggagaccgacccctcgccctactgcatcgtggcccccgacacggtcattcattgtgagggagagccgattaaacgcgaggaagaagaggaggctctcaacgccgtcggctacgacgacatcggcgggtgccgcaagcagctggcgcagatcaaggagatggtggagctgccgctgcgccacccctcgctgttcaaggccatcggggtcaagccgccgcgggggatactgatgtacgggcccccggggacggggaagaccttgatcgctagggctgtcgctaatgagacgggcgcattcttcttcctcatcaacggccccgagatcatgtcgaaactcgccggtgaatccgagtcgaacctgcgcaaggcgttcgaggaggcggacaagaactctccggccatcatcctcattgatgaacttgatgccattgc

SEQ ID NO: 2107 - protein, 246 aa, Plutella xylostella
RKETVCIVLSDDNCPDEKIRMNRVVRNNLRVRLSDIVSIAPCPSVKYGKRVHILPIDDSVEGLTGNLFEVYLKPYFMEAYRPIHRDDTFMVRGGMRAVEFKVVETDPSPYCIVAPDTVIHCEGEPIKREEEEEALNAVGYDDIGGCRKQLAQIKEMVELPLRHPSLFKAIGVKPPRGILMYGPPGTGKTLIARAVANETGAFFFLINGPEIMSKLAGESESNLRKAFEEADKNSPAIILIDELDAI

SEQ ID NO: 2108 - DNA, 1138 bp, ;Plutella xylostella
gttcaccggcgatattctgcgcacgcccgtctctgaggacatgctgggtcgtattttcaacggctccggcaagcccatcgacaaggggcccccgatcctggccgaggagtacctggacatccaggggcagcccatcaacccgtggtcccgtatctacccggaggagatgatccagactggtatctccgctatcgacgtgatgaactccatcgcccgtggtcagaagatccccatcttctccgccgccggtctgccccacaacgagattgctgctcagatctgtaggcaggctggtcttgtcaaggtccccggaaaatccgtgttggacgaccacgaagacaacttcgccatcgtgttcgccgccatgggagtcaacatggagaccgccaggttcttcaagcaggacttcgaggagaacggttccatggagaacgtctgtctgttcttgaacttggccaatgacccgaccattgagaggattatcacgccgaggttggcgctgactgctgccgagttcttggcctaccagtgcgagaaacacgtgttggtaatcttgaccgacatgtcttcatacgcggaggctcttcgtgaagtgtcagccgcccgtgaggaggtgcccggacgacgtggtttcccaggttacatgtacacggatttggccacaatctacgagcgcgccgggcgagtcgagggccgcaacggctccatcacgcagatccccatcctgaccatgcccaacgacgacatcacccaccccatccccgacttgaccgggtacatcactgagggacagatctacgtggaccgtcagctgcacaacaggcagatctacccgccggtgaatgtgctcccgtcgctatctcgtctcatgaagtccgccatcggagagggcatgaccaggaaggaccactccgacgtgtccaaccaactgtacgcgtgctacgccatcggcaaggacgtgcaggcgatgaaggcggtggtgggcgaggaggcgctcacgcccgacgacctgctctacctcgagttcctcaccaagttcgagaagaacttcatcacacagggaagctacgagaaccgcacagtgttcgagtcgctggacatcggctggcagcccctgcgtatcttccccaaggagatg

SEQ ID NO: 2109 - protein, 379 aa, Plutella xylostella
FTGDILRTPVSEDMLGRIFNGSGKPIDKGPPILAEEYLDIQGQPINPWSRIYPEEMIQTGISAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFITQGSYENRTVFESLDIGWQPLRIFPKEM

SEQ ID NO: 2110 - DNA, 23 bp, Artificial sequence
  Primer sequence
ggccccaagaagcatttgaagcg

SEQ ID NO: 2111 - DNA, 28 bp, Artificial sequence
  Primer sequence
cttcgtgcccttgccratkatraabacg

SEQ ID NO: 2112 - DNA, 26 bp, Artificial sequence
  Primer sequence
gcacgttgatctggtacarrggmacc

SEQ ID NO: 2113 - DNA, 20 bp, Artificial sequence
  Primer sequence
gcagcccacgcyytgcactc

SEQ ID NO: 2114 - DNA, 26 bp, Artificial sequence
  Primer sequence
gtggctgcatacagttcattacgcag

SEQ ID NO: 2115 - DNA, 23 bp, Artificial sequence
  Primer sequence
cgcggctgctccatgaayasytg

SEQ ID NO: 2116 - DNA, 20 bp, Artificial sequence
  Primer sequence
gccgcaaggagacbgtvtgc

SEQ ID NO: 2117 - DNA, 24 bp, Artificial sequence
  Primer sequence
gcaatggcatcaakytcrtcratg

SEQ ID NO: 2118 - DNA, 21 bp, Artificial sequence
  Primer sequence
gttcaccggcgayatyctgcg

SEQ ID NO: 2119 - DNA, 25 bp, Artificial sequence
  Primer sequence
catctccttggggaagatacgcagc

SEQ ID NO: 2120 - DNA, 32 bp, Plutella xylostella
aacaacgtgttcatcatcggcaagggcacgaa

SEQ ID NO: 2121 - DNA, 20 bp, Plutella xylostella
aacgtgttcatcatcggcaa

SEQ ID NO: 2122 - DNA, 22 bp, Plutella xylostella
aacgtgttcatcatcggcaagg

SEQ ID NO: 2123 - DNA, 23 bp, Plutella xylostella
aacgtgttcatcatcggcaaggg

SEQ ID NO: 2124 - DNA, 29 bp, Plutella xylostella
aacgtgttcatcatcggcaagggcacgaa

SEQ ID NO: 2125 - DNA, 29 bp, Plutella xylostella
aacttggggcgagtgggcaccatcgtgtc

SEQ ID NO: 2126 - DNA, 36 bp, Plutella xylostella
aacttggggcgagtgggcaccatcgtgtcccgcgag

SEQ ID NO: 2127 - DNA, 41 bp, Plutella xylostella
aagatcgtgaagcagcgcctcatcaaggtggacggcaaggt

SEQ ID NO: 2128 - DNA, 23 bp, Plutella xylostella
aaggtccgcaccgaccccaccta

SEQ ID NO: 2129 - DNA, 21 bp, Plutella xylostella
aagtacaagctgtgcaaggtg

SEQ ID NO: 2130 - DNA, 31 bp, Plutella xylostella
acaacgtgttcatcatcggcaagggcacgaa

SEQ ID NO: 2131 - DNA, 22 bp, Plutella xylostella
acggcaaggtccgcaccgaccc

SEQ ID NO: 2132 - DNA, 50 bp, Plutella xylostella
acggccgcacgctgcgctaccccgacccgctcatcaaggtcaacgactcc

SEQ ID NO: 2133 - DNA, 25 bp, Plutella xylostella
acgtgttcatcatcggcaagggcac

SEQ ID NO: 2134 - DNA, 21 bp, Plutella xylostella
aggaggccaagtacaagctgt

SEQ ID NO: 2135 - DNA, 28 bp, Plutella xylostella
aggaggccaagtacaagctgtgcaaggt

SEQ ID NO: 2136 - DNA, 29 bp, Plutella xylostella
aggaggccaagtacaagctgtgcaaggtg

SEQ ID NO: 2137 - DNA, 21 bp, Plutella xylostella
caacgtgttcatcatcggcaa

SEQ ID NO: 2138 - DNA, 26 bp, Plutella xylostella
caacgtgttcatcatcggcaagggca

SEQ ID NO: 2139 - DNA, 32 bp, Plutella xylostella
cacaccttcgccaccaggttgaacaacgtgtt

SEQ ID NO: 2140 - DNA, 21 bp, Plutella xylostella
ccccaagaagcatttgaagcg

SEQ ID NO: 2141 - DNA, 22 bp, Plutella xylostella
ccgaggaggccaagtacaagct

SEQ ID NO: 2142 - DNA, 31 bp, Plutella xylostella
ccgaggaggccaagtacaagctgtgcaaggt

SEQ ID NO: 2143 - DNA, 29 bp, Plutella xylostella
ccgcacaagctgcgcgagtgcctgccgct

SEQ ID NO: 2144 - DNA, 22 bp, Plutella xylostella
cgacgggccccaagaacgtgcc

SEQ ID NO: 2145 - DNA, 21 bp, Plutella xylostella
cgaggaggccaagtacaagct

SEQ ID NO: 2146 - DNA, 22 bp, Plutella xylostella
cgaggaggccaagtacaagctg

SEQ ID NO: 2147 - DNA, 27 bp, Plutella xylostella
cgagtgggcaccatcgtgtcccgcgag

SEQ ID NO: 2148 - DNA, 36 bp, Plutella xylostella
cgctaccccgacccgctcatcaaggtcaacgactcc

SEQ ID NO: 2149 - DNA, 23 bp, Plutella xylostella
cgcttcaccatccaccgcatcac

SEQ ID NO: 2150 - DNA, 24 bp, Plutella xylostella
cggcaacgaggtgctgaagatcgt

SEQ ID NO: 2151 - DNA, 23 bp, Plutella xylostella
cgtaacttggggcgagtgggcac

SEQ ID NO: 2152 - DNA, 24 bp, Plutella xylostella
ctacccggctggattcatggatgt

SEQ ID NO: 2153 - DNA, 21 bp, Plutella xylostella
ctcatcaaggtcaacgactcc

SEQ ID NO: 2154 - DNA, 35 bp, Plutella xylostella; identical to SEQ ID NO: 1744

SEQ ID NO: 2155 - DNA, 21 bp, Plutella xylostella
gacggcaaggtccgcaccgac

SEQ ID NO: 2156 - DNA, 23 bp, Plutella xylostella
gacggcaaggtccgcaccgaccc

SEQ ID NO: 2157 - DNA, 29 bp, Plutella xylostella
gaggaggccaagtacaagctgtgcaaggt

SEQ ID NO: 2158 - DNA, 30 bp, Plutella xylostella
gaggaggccaagtacaagctgtgcaaggtg

SEQ ID NO: 2159 - DNA, 23 bp, Plutella xylostella
gaggccaagtacaagctgtgcaa

SEQ ID NO: 2160 - DNA, 27 bp, Plutella xylostella
gaggccaagtacaagctgtgcaaggtg

SEQ ID NO: 2161 - DNA, 23 bp, Plutella xylostella
gccaagtacaagctgtgcaaggt

SEQ ID NO: 2162 - DNA, 22 bp, Plutella xylostella
gccccaagaagcatttgaagcg

SEQ ID NO: 2163 - DNA, 21 bp, Plutella xylostella
gcgcgtggcgacgggccccaa

SEQ ID NO: 2164 - DNA, 22 bp, Plutella xylostella
gcgcgtggcgacgggccccaag

SEQ ID NO: 2165 - DNA, 27 bp, Plutella xylostella
ggaggccaagtacaagctgtgcaaggt

SEQ ID NO: 2166 - DNA, 23 bp, Plutella xylostella
ggccccaagaagcatttgaagcg

SEQ ID NO: 2167 - DNA, 24 bp, Plutella xylostella
ggcggcgtgtacgcgccgcggccc

SEQ ID NO: 2168 - DNA, 23 bp, Plutella xylostella
gtccgcaccgaccccacctaccc

SEQ ID NO: 2169 - DNA, 26 bp, Plutella xylostella
gtgggcaccatcgtgtcccgcgagag

SEQ ID NO: 2170 - DNA, 31 bp, Plutella xylostella
tcaaggtggacggcaaggtccgcaccgaccc

SEQ ID NO: 2171 - DNA, 22 bp, Plutella xylostella
tgatctacgatgtgaagggacg

SEQ ID NO: 2172 - DNA, 26 bp, Plutella xylostella
ttcatggatgttgtgtcgattgaaaa

SEQ ID NO: 2173 - DNA, 21 bp, Plutella xylostella
gctggattcatggatgttgtg

SEQ ID NO: 2174 - DNA, 42 bp, Plutella xylostella
aagcagcgcctcatcaaggtggacggcaaggtccgcaccgac

SEQ ID NO: 2175 - DNA, 21 bp, Plutella xylostella
aacatcttcaactgtgacttc

SEQ ID NO: 2176 - DNA, 22 bp, Plutella xylostella
tgatcaacatcgagtgcaaagc

SEQ ID NO: 2177 - DNA, 22 bp, Plutella xylostella
ttcttgaagctgaataagatct

SEQ ID NO: 2178 - DNA, 23 bp, Plutella xylostella
cagttcctgcaggtcttcaacaa

SEQ ID NO: 2179 - DNA, 27 bp, Plutella xylostella
ccatcagcggacggtggcgcccccgtg

SEQ ID NO: 2180 - DNA, 37 bp, Plutella xylostella
cccgcagttcatgtaccacctgcgccgctcgcagttc

SEQ ID NO: 2181 - DNA, 32 bp, Plutella xylostella
ccgaacagcttccgtctgtcggagaacttcag

SEQ ID NO: 2182 - DNA, 28 bp, Plutella xylostella
cgcctgtgccagaagttcggcgagtacg

SEQ ID NO: 2183 - DNA, 26 bp, Plutella xylostella
ctgcgccgctcgcagttcctgcaggt

SEQ ID NO: 2184 - DNA, 23 bp, Plutella xylostella
ctgtacccgcagttcatgtacca

SEQ ID NO: 2185 - DNA, 23 bp, Plutella xylostella
gacgtgctgcgctggctcgaccg

SEQ ID NO: 2186 - DNA, 29 bp, Plutella xylostella
gacgtgtcgctgcaagtgttcatggagca

SEQ ID NO: 2187 - DNA, 28 bp, Plutella xylostella
gagtacgagaacttcaagcagctgctgc

SEQ ID NO: 2188 - DNA, 23 bp, Plutella xylostella
ggcggggcgatgccgataccatc

SEQ ID NO: 2189 - DNA, 35 bp, Plutella xylostella
gtggctgcatacagttcattacgcagtaccagcac

SEQ ID NO: 2190 - DNA, 26 bp, Plutella xylostella
tcgcagttcctgcaggtcttcaacaa

SEQ ID NO: 2191 - DNA, 34 bp, Plutella xylostella
tgcgccgctcgcagttcctgcaggtcttcaacaa

SEQ ID NO: 2192 - DNA, 52 bp, Plutella xylostella
tgcgccgctcgcagttcctgcaggtcttcaacaactcgcccgacgagaccac

SEQ ID NO: 2193 - DNA, 65 bp, Plutella xylostella
ttcatgtaccacctgcgccgctcgcagttcctgcaggtcttcaacaactcgcccgacgagaccac

SEQ ID NO: 2194 - DNA, 26 bp, Plutella xylostella
atcctgctcatggacaccttcttcca

SEQ ID NO: 2195 - DNA, 32 bp, Plutella xylostella
caccgcgacgacacgttcatggtgcgcggcgg

SEQ ID NO: 2196 - DNA, 21 bp, Plutella xylostella
cagatcaaggagatggtggag

SEQ ID NO: 2197 - DNA, 23 bp, Plutella xylostella
cccgacgagaagatccgcatgaa

SEQ ID NO: 2198 - DNA, 29 bp, Plutella xylostella
cccgacgagaagatccgcatgaaccgcgt

SEQ ID NO: 2199 - DNA, 28 bp, Plutella xylostella
ccgacgagaagatccgcatgaaccgcgt

SEQ ID NO: 2200 - DNA, 26 bp, Plutella xylostella
cgcaaggagaccgtgtgcattgtgct

SEQ ID NO: 2201 - DNA, 23 bp, Plutella xylostella
gacgagaagatccgcatgaaccg

SEQ ID NO: 2202 - DNA, 26 bp, Plutella xylostella
gacgagaagatccgcatgaaccgcgt

SEQ ID NO: 2203 - DNA, 26 bp, Plutella xylostella
gcgcagatcaaggagatggtggagct

SEQ ID NO: 2204 - DNA, 21 bp, Plutella xylostella
ggcatgcgcgccgtcgagttc

SEQ ID NO: 2205 - DNA, 21 bp, Plutella xylostella
gtgcgcggcggcatgcgcgcc

SEQ ID NO: 2206 - DNA, 21 bp, Plutella xylostella
tcaaggagatggtggagctgc

SEQ ID NO: 2207 - DNA, 22 bp, Plutella xylostella
tgaagccgtacttcatggaggc

SEQ ID NO: 2208 - DNA, 35 bp, Plutella xylostella
tgccgcaagcagctggcgcagatcaaggagatggt

SEQ ID NO: 2209 - DNA, 23 bp, Plutella xylostella
tggaggcgtaccggcccatccac

SEQ ID NO: 2210 - DNA, 23 bp, Plutella xylostella
aaggaccactccgacgtgtccaa

SEQ ID NO: 2211 - DNA, 23 bp, Plutella xylostella
aaggacgtgcaggcgatgaaggc

SEQ ID NO: 2212 - DNA, 24 bp, Plutella xylostella
accaagttcgagaagaacttcatc

SEQ ID NO: 2213 - DNA, 26 bp, Plutella xylostella
accaagttcgagaagaacttcatcac

SEQ ID NO: 2214 - DNA, 29 bp, Plutella xylostella
accgccaggttcttcaagcaggacttcga

SEQ ID NO: 2215 - DNA, 29 bp, Plutella xylostella
accggcgatattctgcgcacgcccgtctc

SEQ ID NO: 2216 - DNA, 22 bp, Plutella xylostella
agcaggacttcgaggagaacgg

SEQ ID NO: 2217 - DNA, 29 bp, Plutella xylostella
atcacgcagatccccatcctgaccatgcc

SEQ ID NO: 2218 - DNA, 26 bp, Plutella xylostella
atcttgaccgacatgtcttcatacgc

SEQ ID NO: 2219 - DNA, 26 bp, Plutella xylostella
atgaccaggaaggaccactccgacgt

SEQ ID NO: 2220 - DNA, 23 bp, Plutella xylostella
atgcccaacgacgacatcaccca

SEQ ID NO: 2221 - DNA, 44 bp, Plutella xylostella
cagaagatccccatcttctccgccgccggtctgccccacaacga

SEQ ID NO: 2222 - DNA, 35 bp, Plutella xylostella
caggacttcgaggagaacggttccatggagaacgt

SEQ ID NO: 2223 - DNA, 23 bp, Plutella xylostella
ccaagttcgagaagaacttcatc

SEQ ID NO: 2224 - DNA, 35 bp, Plutella xylostella
cccatcaacccgtggtcccgtatctacccggagga

SEQ ID NO: 2225 - DNA, 41 bp, Plutella xylostella
cccgacttgaccgggtacatcactgagggacagatctacgt

SEQ ID NO: 2226 - DNA, 35 bp, Plutella xylostella
cccggacgacgtggtttcccaggttacatgtacac

SEQ ID NO: 2227 - DNA, 30 bp, Plutella xylostella
cctggacatccaggggcagcccatcaaccc

SEQ ID NO: 2228 - DNA, 38 bp, Plutella xylostella
cgacgtggtttcccaggttacatgtacacggatttggc

SEQ ID NO: 2229 - DNA, 23 bp, Plutella xylostella
cgtctcatgaagtccgccatcgg

SEQ ID NO: 2230 - DNA, 36 bp, Plutella xylostella
cgtctcatgaagtccgccatcggagagggcatgacc

SEQ ID NO: 2231 - DNA, 26 bp, Plutella xylostella
cgtggtcagaagatccccatcttctc

SEQ ID NO: 2232 - DNA, 29 bp, Plutella xylostella
cgtggtcagaagatccccatcttctccgc

SEQ ID NO: 2233 - DNA, 26 bp, Plutella xylostella
cgtggtttcccaggttacatgtacac

SEQ ID NO: 2234 - DNA, 59 bp, Plutella xylostella
cgtggtttcccaggttacatgtacacggatttggccacaatctacgagcgcgccgggcg

SEQ ID NO: 2235 - DNA, 27 bp, Plutella xylostella
ctacgagaaccgcacagtgttcgagtc

SEQ ID NO: 2236 - DNA, 23 bp, Plutella xylostella
ctgcgtatcttccccaaggagat

SEQ ID NO: 2237 - DNA, 23 bp, Plutella xylostella
ctgtacgcgtgctacgccatcgg

SEQ ID NO: 2238 - DNA, 23 bp, Plutella xylostella
ctgttcttgaacttggccaatga

SEQ ID NO: 2239 - DNA, 26 bp, Plutella xylostella
ctgttcttgaacttggccaatgaccc

SEQ ID NO: 2240 - DNA, 23 bp, Plutella xylostella
gacaacttcgccatcgtgttcgc

SEQ ID NO: 2241 - DNA, 26 bp, Plutella xylostella
gacaacttcgccatcgtgttcgccgc

SEQ ID NO: 2242 - DNA, 32 bp, Plutella xylostella
gacaacttcgccatcgtgttcgccgccatggg

SEQ ID NO: 2243 - DNA, 23 bp, Plutella xylostella
gaccgtcagctgcacaacaggca

SEQ ID NO: 2244 - DNA, 21 bp, Plutella xylostella
gacctgctctacctcgagttc

SEQ ID NO: 2245 - DNA, 23 bp, Plutella xylostella
gacgtgatgaactccatcgcccg

SEQ ID NO: 2246 - DNA, 26 bp, Plutella xylostella
gacgtgatgaactccatcgcccgtgg

SEQ ID NO: 2247 - DNA, 23 bp, Plutella xylostella
gagaacggttccatggagaacgt

SEQ ID NO: 2248 - DNA, 32 bp, Plutella xylostella
gaggagatgatccagactggtatctccgctat

SEQ ID NO: 2249 - DNA, 50 bp, Plutella xylostella
gaggagatgatccagactggtatctccgctatcgacgtgatgaactccat

SEQ ID NO: 2250 - DNA, 24 bp, Plutella xylostella
gaggaggcgctcacgcccgacgac

SEQ ID NO: 2251 - DNA, 26 bp, Plutella xylostella
gagttcttggcctaccagtgcgagaa

SEQ ID NO: 2252 - DNA, 35 bp, Plutella xylostella
gccaggttcttcaagcaggacttcgaggagaacgg

SEQ ID NO: 2253 - DNA, 23 bp, Plutella xylostella
gcccgtggtcagaagatccccat

SEQ ID NO: 2254 - DNA, 29 bp, Plutella xylostella
gcccgtggtcagaagatccccatcttctc

SEQ ID NO: 2255 - DNA, 35 bp, Plutella xylostella
gcccgtggtcagaagatccccatcttctccgccgc

SEQ ID NO: 2256 - DNA, 29 bp, Plutella xylostella
gccgagttcttggcctaccagtgcgagaa

SEQ ID NO: 2257 - DNA, 41 bp, Plutella xylostella
gccgagttcttggcctaccagtgcgagaaacacgtgttggt

SEQ ID NO: 2258 - DNA, 26 bp, Plutella xylostella
gccgcccgtgaggaggtgcccggacg

SEQ ID NO: 2259 - DNA, 47 bp, Plutella xylostella
gcctaccagtgcgagaaacacgtgttggtaatcttgaccgacatgtc

SEQ ID NO: 2260 - DNA, 22 bp, Plutella xylostella
ggcagatctacccgccggtgaa

SEQ ID NO: 2261 - DNA, 26 bp, Plutella xylostella
ggcgaggaggcgctcacgcccgacga

SEQ ID NO: 2262 - DNA, 23 bp, Plutella xylostella
ggtcagaagatccccatcttctc

SEQ ID NO: 2263 - DNA, 26 bp, Plutella xylostella
ggttacatgtacacggatttggccac

SEQ ID NO: 2264 - DNA, 26 bp, Plutella xylostella
gtggtgggcgaggaggcgctcacgcc

SEQ ID NO: 2265 - DNA, 21 bp, Plutella xylostella
gttcaccggcgatattctgcg

SEQ ID NO: 2266 - DNA, 24 bp, Plutella xylostella
gttcaccggcgatattctgcgcac

SEQ ID NO: 2267 - DNA, 26 bp, Plutella xylostella
taccagtgcgagaaacacgtgttggt

SEQ ID NO: 2268 - DNA, 35 bp, Plutella xylostella
tacgccatcggcaaggacgtgcaggcgatgaaggc

SEQ ID NO: 2269 - DNA, 23 bp, Plutella xylostella
tccatcacgcagatccccatcct

SEQ ID NO: 2270 - DNA, 23 bp, Plutella xylostella
tccggcaagcccatcgacaaggg

SEQ ID NO: 2271 - DNA, 23 bp, Plutella xylostella
tctacgagcgcgccgggcgagtc

SEQ ID NO: 2272 - DNA, 26 bp, Plutella xylostella
tctcgtctcatgaagtccgccatcgg

SEQ ID NO: 2273 - DNA, 49 bp, Plutella xylostella
tgactgctgccgagttcttggcctaccagtgcgagaaacacgtgttggt

SEQ ID NO: 2274 - DNA, 22 bp, Plutella xylostella
tgcacaacaggcagatctaccc

SEQ ID NO: 2275 - DNA, 22 bp, Plutella xylostella
tgcgtatcttccccaaggagat

SEQ ID NO: 2276 - DNA, 29 bp, Plutella xylostella
tgctacgccatcggcaaggacgtgcaggc

SEQ ID NO: 2277 - DNA, 44 bp, Plutella xylostella
tgctctacctcgagttcctcaccaagttcgagaagaacttcatc

SEQ ID NO: 2278 - DNA, 23 bp, Plutella xylostella
tgtctgttcttgaacttggccaa

SEQ ID NO: 2279 - DNA, 26 bp, Plutella xylostella
tgtctgttcttgaacttggccaatga

SEQ ID NO: 2280 - DNA, 22 bp, Plutella xylostella
tgttcttgaacttggccaatga

SEQ ID NO: 2281 - DNA, 23 bp, Plutella xylostella
ttcaacggctccggcaagcccat

SEQ ID NO: 2282 - DNA, 32 bp, Plutella xylostella
ttcaacggctccggcaagcccatcgacaaggg

SEQ ID NO: 2283 - DNA, 26 bp, Plutella xylostella
ttcgaggagaacggttccatggagaa

SEQ ID NO: 2284 - DNA, 29 bp, Plutella xylostella
ttcgaggagaacggttccatggagaacgt

SEQ ID NO: 2285 - DNA, 26 bp, Plutella xylostella
ttcttcaagcaggacttcgaggagaa

SEQ ID NO: 2286 - DNA, 29 bp, Plutella xylostella
ttcttcaagcaggacttcgaggagaacgg

SEQ ID NO: 2287 - DNA, 32 bp, Plutella xylostella
ttcttcaagcaggacttcgaggagaacggttc

SEQ ID NO: 2288 - DNA, 44 bp, Plutella xylostella
ttcttcaagcaggacttcgaggagaacggttccatggagaacgt

SEQ ID NO: 2289 - DNA, 23 bp, Plutella xylostella
ttcttgaacttggccaatgaccc

SEQ ID NO: 2290 - DNA, 23 bp, Plutella xylostella
ttcttggcctaccagtgcgagaa

SEQ ID NO: 2291 - DNA, 21 bp, Plutella xylostella
ctcgacatcgccacctgcaag

SEQ ID NO: 2292 - DNA, 21 bp, Plutella xylostella
gacggcaaggtccgcaccgac

SEQ ID NO: 2293 - DNA, 21 bp, Plutella xylostella
cccggctggattcatggatgt

SEQ ID NO: 2294 - DNA, 26 bp, Plutella xylostella
atcaaggtggacggcaaggtccgcac

SEQ ID NO: 2295 - DNA, 22 bp, Plutella xylostella
acaacgtgttcatcatcggcaa

SEQ ID NO: 2296 - DNA, 35 bp, Plutella xylostella
cgtggtttcccaggttacatgtacacggatttggc

SEQ ID NO: 2297 - DNA, 23 bp, Plutella xylostella
ggtttcccaggttacatgtacac

SEQ ID NO: 2298 - DNA, 29 bp, Plutella xylostella
gagttcctcaccaagttcgagaagaactt

SEQ ID NO: 2299 - DNA, 23 bp, Plutella xylostella
ctcatcaaggtggacggcaaggt

SEQ ID NO: 2300 - DNA, 28 bp, Plutella xylostella
tcggtgcggaccttgccgtccaccttga

SEQ ID NO: 2301 - DNA, 21 bp, Plutella xylostella
gacggcaaggtccgcaccgac

SEQ ID NO: 2302 - DNA, 23 bp, Plutella xylostella
gacggcaaggtccgcaccgaccc

SEQ ID NO: 2303 - DNA, 26 bp, Plutella xylostella
aaggtccgcaccgaccccacctaccc

SEQ ID NO: 2304 - DNA, 23 bp, Plutella xylostella
cgcttcaccatccaccgcatcac

SEQ ID NO: 2305 - DNA, 22 bp, Plutella xylostella
cgaggaggccaagtacaagctg

SEQ ID NO: 2306 - DNA, 26 bp, Plutella xylostella
gaggccaagtacaagctgtgcaaggt

SEQ ID NO: 2307 - DNA, 21 bp, Plutella xylostella
gccaagtacaagctgtgcaag

SEQ ID NO: 2308 - DNA, 27 bp, Plutella xylostella
cccgacccgctcatcaaggtcaacgac

SEQ ID NO: 2309 - DNA, 22 bp, Plutella xylostella
cgacatcgtccacatcaaggac

SEQ ID NO: 2310 - DNA, 30 bp, Plutella xylostella
ccgcacaagctgcgcgagtgcctgccgctc

SEQ ID NO: 2311 - DNA, 23 bp, Plutella xylostella
ttcgaccaggaggcggcggcggt

SEQ ID NO: 2312 - DNA, 21 bp, Plutella xylostella
caccaccgccgccgcctcctg

SEQ ID NO: 2313 - DNA, 28 bp, Plutella xylostella
tgcaggtcttcaacaactcgcccgacga

SEQ ID NO: 2314 - DNA, 23 bp, Plutella xylostella
ttcaacaactcgcccgacgagac

SEQ ID NO: 2315 - DNA, 27 bp, Plutella xylostella
catgcgcgccgtcgagttcaaggtggt

SEQ ID NO: 2316 - DNA, 23 bp, Plutella xylostella
gcattcttcttcctcatcaacgg

SEQ ID NO: 2317 - DNA, 23 bp, Plutella xylostella
atcaacggccccgagatcatgtc

SEQ ID NO: 2318 - DNA, 22 bp, Plutella xylostella
tgcgcaaggcgttcgaggaggc

SEQ ID NO: 2319 - DNA, 25 bp, Plutella xylostella
cctcaccaagttcgagaagaacttc

SEQ ID NO: 2320 - DNA, 23 bp, Plutella xylostella
gaggagatgatccagactggtat

SEQ ID NO: 2321 - DNA, 26 bp, Plutella xylostella
gaggagatgatccagactggtatctc

SEQ ID NO: 2322 - DNA, 32 bp, Plutella xylostella
atgaactccatcgcccgtggtcagaagatccc

SEQ ID NO: 2323 - DNA, 26 bp, Plutella xylostella
gtcagaagatccccatcttctccgcc

SEQ ID NO: 2324 - DNA, 23 bp, Plutella xylostella
cagaagatccccatcttctccgc

SEQ ID NO: 2325 - DNA, 24 bp, Plutella xylostella
cagaagatccccatcttctccgcc

SEQ ID NO: 2326 - DNA, 29 bp, Plutella xylostella
cagaagatccccatcttctccgccgccgg

SEQ ID NO: 2327 - DNA, 29 bp, Plutella xylostella
aagatccccatcttctccgccgccggtct

SEQ ID NO: 2328 - DNA, 26 bp, Plutella xylostella
cccatcttctccgccgccggtctgcc

SEQ ID NO: 2329 - DNA, 26 bp, Plutella xylostella
ggtctgccccacaacgagattgctgc

SEQ ID NO: 2330 - DNA, 29 bp, Plutella xylostella
ttcgccgccatgggagtcaacatggagac

SEQ ID NO: 2331 - DNA, 23 bp, Plutella xylostella
accgccaggttcttcaagcagga

SEQ ID NO: 2332 - DNA, 23 bp, Plutella xylostella
ctgttcttgaacttggccaatga

SEQ ID NO: 2333 - DNA, 21 bp, Plutella xylostella
ggttacatgtacacggatttg

SEQ ID NO: 2334 - DNA, 24 bp, Plutella xylostella
ggcaagcccatcgacaaggggccc

SEQ ID NO: 2335 - DNA, 34 bp, Plutella xylostella
atggggtgggtgatgtcgtcgttgggcatggtca

SEQ ID NO: 2336 - DNA, 29 bp, Plutella xylostella
accatgcccaacgacgacatcacccaccc

SEQ ID NO: 2337 - DNA, 22 bp, Plutella xylostella
tgcacaacaggcagatctaccc

SEQ ID NO: 2338 - DNA, 23 bp, Plutella xylostella
ccgtcgctatctcgtctcatgaa

SEQ ID NO: 2339 - DNA, 514 bp, Plutella xylostella
cgaggtgctgaagatcgtgaagcagcgcctcatcaaggtggacggcaaggtccgcaccgaccccacctacccggctggattcatggatgttgtgtcgattgaaaagaccaatgagctgttccgtctgatctacgatgtgaagggacgcttcaccatccaccgcatcactcccgaggaggccaagtacaagctgtgcaaggtgaagcgcgtggcgacgggccccaagaacgtgccgtacatcgtgacgcacaacggccgcacgctgcgctaccccgacccgctcatcaaggtcaacgactccatccagctcgacatcgccacctgcaagatcatggacatcatcaagttcgactcaggtaacctgtgcatgatcacgggagggcgtaacttggggcgagtgggcaccatcgtgtcccgcgagaggcaccccgggagcttcgacatcgtccacatcaaggacaccaccggacacaccttcgccaccaggttgaacaacgtgttcatcatcggcaag

SEQ ID NO: 2340 - DNA, 44 bp, Artificial sequence
  Primer sequence
gcgtaatacgactcactataggcgaggtgctgaagatcgtgaag

SEQ ID NO: 2341 - DNA, 22 bp, Artificial sequence
  Primer sequence
cttgccgatgatgaacacgttg

SEQ ID NO: 2342 - DNA, 22 bp, Artificial sequence
  Primer sequence
cgaggtgctgaagatcgtgaag

SEQ ID NO: 2343 - DNA, 44 bp, Artificial sequence
  Primer sequence
gcgtaatacgactcactataggcttgccgatgatgaacacgttg

SEQ ID NO: 2344 - DNA, 524 bp, Plutella xylostella
cagctacaagtattgggagaaccagctcattgactttttgtcagtatacaagaagaagggtcagacagcgggtgctggtcagaacatcttcaactgtgacttccgcaacccgcccccacacggcaaggtgtgcgacgtggacatccgcggctgggagccctgcattgatgagaaccacttctctttccacaagtcttcgccttgcatcttcttgaagctgaataagatctacggctggcgtccagagttctacaacgacacggctaacctgcctgaagccatgcccgtggacttgcagacccacattcgtaacattactgccttcaacagagactatgcgaacatggtgtgggtgtcgtgccacggcgagacgccggcggacaaggagaacatcgggccggtgcgctacctgccctacccgggcttccccgggtacttctacccgtacgagaacgccgaggggtatctgagcccgctggtcgccgtgcatttggagaggccgaggaccggcatagtgatcaaca

SEQ ID NO: 2345 - DNA, 47 bp, Artificial sequence
  Primer sequence
gcgtaatacgactcactataggcagctacaagtattgggagaaccag

SEQ ID NO: 2346 - DNA, 22 bp, Artificial sequence
  Primer sequence
tgttgatcactatgccggtcct

SEQ ID NO: 2347 - DNA, 25 bp, Artificial sequence
  Primer sequence
cagctacaagtattgggagaaccag

SEQ ID NO: 2348 - DNA, 44 bp, Artificial sequence
  Primer sequence
gcgtaatacgactcactataggtgttgatcactatgccggtcct

SEQ ID NO: 2349 - DNA, 672 bp, Plutella xylostella
accagcactctagtggacaacgtcgcgttcgggtcaccactgtcgcgcgcaattggggcgacgcagccgccaacttacaccacatatcggcgggcttcgaccaggaggcggcggcggtggtgatggcgcggctggtggtgtaccgcgcggagcaggaggacgggcccgacgtgctgcgctggctcgaccgcatgctcatacgcctgtgccagaagttcggcgagtacgcgaaggacgacccgaacagcttccgtctgtcggagaacttcagcctgtacccgcagttcatgtaccacctgcgccgctcgcagttcctgcaggtcttcaacaactcgcccgacgagaccaccttctacagacacatgctgatgcgcgaagacctgacccaatccctcatcatgatccagccgatcctctactcgtacagcttcggaggcgcgcccgaacccgtgctgttagacaccagctccatccagcccgaccgcatcctgctcatggacaccttcttccagatcctcatctaccatggagagacaatggcgcaatggcgcgctctccgctaccaagacatggctgagtacgagaacttcaagcagctgctgcgagcgcccgtggacgacgcgcaggagatcctgcagaccaggttccccgtgccgcggtacattgatacag

SEQ ID NO: 2350 - DNA, 46 bp, Artificial sequence
  Primer sequence
gcgtaatacgactcactataggaccagcactctagtggacaacgtc

SEQ ID NO: 2351 - DNA, 22 bp, Artificial sequence
  Primer sequence
ctgtatcaatgtaccgcggcac

SEQ ID NO: 2352 - DNA, 24 bp, Artificial sequence
  Primer sequence
accagcactctagtggacaacgtc

SEQ ID NO: 2353 - DNA, 44 bp, Artificial sequence
  Primer sequence
gcgtaatacgactcactataggctgtatcaatgtaccgcggcac

SEQ ID NO: 2354 - DNA, 669 bp, Plutella xylostella
gacgagaagatccgcatgaaccgcgtcgtccggaacaacctgcgagtgcgcctgtcagacattgtgtccatcgctccttgcccgtcagtgaagtacggcaagagagttcatattctgcccattgatgactctgttgagggtttgactggaaacctgttcgaagtctacctgaagccgtacttcatggaggcgtaccggcccatccaccgcgacgacacgttcatggtgcgcggcggcatgcgcgccgtcgagttcaaggtggtggagaccgacccctcgccctactgcatcgtggcccccgacacggtcattcattgtgagggagagccgattaaacgcgaggaagaagaggaggctctcaacgccgtcggctacgacgacatcggcgggtgccgcaagcagctggcgcagatcaaggagatggtggagctgccgctgcgccacccctcgctgttcaaggccatcggggtcaagccgccgcgggggatactgatgtacgggcccccggggacggggaagaccttgatcgctagggctgtcgctaatgagacgggcgcattcttcttcctcatcaacggccccgagatcatgtcgaaactcgccggtgaatccgagtcgaacctgcgcaaggcgttcgaggaggcggacaagaactctccggccatcatc

SEQ ID NO: 2355 - DNA, 44 bp, Artificial sequence
  Primer sequence
gcgtaatacgactcactatagggacgagaagatccgcatgaacc

SEQ ID NO: 2356 - DNA, 22 bp, Artificial sequence
  Primer sequence
gatgatggccggagagttcttg

SEQ ID NO: 2357 - DNA, 22 bp, Artificial sequence
  Primer sequence
gacgagaagatccgcatgaacc

SEQ ID NO: 2358 - DNA, 44 bp, Artificial sequence
  Primer sequence
gcgtaatacgactcactatagggatgatggccggagagttcttg

SEQ ID NO: 2359 - DNA, 741 bp, Plutella xylostella
ctgggtcgtattttcaacggctccggcaagcccatcgacaaggggcccccgatcctggccgaggagtacctggacatccaggggcagcccatcaacccgtggtcccgtatctacccggaggagatgatccagactggtatctccgctatcgacgtgatgaactccatcgcccgtggtcagaagatccccatcttctccgccgccggtctgccccacaacgagattgctgctcagatctgtaggcaggctggtcttgtcaaggtccccggaaaatccgtgttggacgaccacgaagacaacttcgccatcgtgttcgccgccatgggagtcaacatggagaccgccaggttcttcaagcaggacttcgaggagaacggttccatggagaacgtctgtctgttcttgaacttggccaatgacccgaccattgagaggattatcacgccgaggttggcgctgactgctgccgagttcttggcctaccagtgcgagaaacacgtgttggtaatcttgaccgacatgtcttcatacgcggaggctcttcgtgaagtgtcagccgcccgtgaggaggtgcccggacgacgtggtttcccaggttacatgtacacggatttggccacaatctacgagcgcgccgggcgagtcgagggccgcaacggctccatcacgcagatccccatcctgaccatgcccaacgacgacatcacccaccccatccccgacttgaccgggtacatcact

SEQ ID NO: 2360 - DNA, 45 bp, Artificial sequence
  Primer sequence
gcgtaatacgactcactataggctgggtcgtattttcaacggctc

SEQ ID NO: 2361 - DNA, 22 bp, Artificial sequence
  Primer sequence
agtgatgtacccggtcaagtcg

SEQ ID NO: 2362 - DNA, 23 bp, Artificial sequence
  Primer sequence
ctgggtcgtattttcaacggctc

SEQ ID NO: 2363 - DNA, 44 bp, Artificial sequence
  Primer sequence
gcgtaatacgactcactataggagtgatgtacccggtcaagtcg

SEQ ID NO: 2364 - DNA, 755 bp, Acheta domesticus
ggccccaagaagcatttgaagcgtttaaatgctcctaaagcatggatgttggacaaactcggaggagtattcgctcctcgccccagtactggcccccacaaattgcgtgaatgtttacctttggtgatttttcttcgcaatcggctcaagtatgctctgacgaactgtgaagtaacgaagattgttatgcagcgacttatcaaagttgacggcaaggtgcgaaccgatccgaattatcccgctggtttcatggatgttgtcaccattgagaagactggagagttcttcaggctggtgtatgatgtgaaaggccgtttcacaattcacagaattagtgcagaagaagccaagtacaagctctgcaaggtcaggagagttcaaactgggccaaaaggtattccattcttggtgacccatgatggccgtactatccgttatcctgacccagtcattaaagttaatgactcaatccaattggatattgccacttgtaaaatcatggaccacatcagatttgaatctggcaacctgtgtatgattactggtggacgtaacttgggtcgagtggggactgttgtgagtcgagaacgtcacccaggctcgtttgatattgttcatatcaaggatacccaaggacatacttttgccacaagattgaataatgtattcatcattggaaaagctacaaagccttacatttcattgccaaagggtaagggtgtgaaattgagtatcgccgaggagcgggacaagcg

SEQ ID NO: 2365 - protein, 251 aa, Acheta domesticus
GPKKHLKRLNAPKAWMLDKLGGVFAPRPSTGPHKLRECLPLVIFLRNRLKYALTNCEVTKIVMQRLIKVDGKVRTDPNYPAGFMDVVTIEKTGEFFRLVYDVKGRFTIHRISAEEAKYKLCKVRRVQTGPKGIPFLVTHDGRTIRYPDPVIKVNDSIQLDIATCKIMDHIRFESGNLCMITGGRNLGRVGTVVSRERHPGSFDIVHIKDTQGHTFATRLNNVFIIGKATKPYISLPKGKGVKLSIAEERDK

SEQ ID NO: 2366 - DNA, 396 bp, Acheta domesticus
gagtttctttagtaaagtattcggtgggaagaaagatggaaaggctccgaccactggtgaggccattcagaaactcagagaaacagaagaaatgttaatcaaaaagcaggaatttttagagaagaaaatcgaacaagaaatcaatgttgcaaagaaaaatggaacgaaaaataagcgagctgctattcaggctctgaaaaggaaaaagaggtatgaaaaacaattgcagcaaattgatggcaccttatccacaattgaaatgcaaagagaagctttggagggtgctaatactaatacagctgtattacaaacaatgaaatcagcagcagatgcccttaaagcagctcatcagcacatggatgtggacaaggtacatgacctgatggatgacattgc

SEQ ID NO: 2367 - protein, 131 aa, Acheta domesticus
SFFSKVFGGKKDGKAPTTGEAIQKLRETEEMLIKKQEFLEKKIEQEINVAKKNGTKNKRAAIQALKRKKRYEKQLQQIDGTLSTIEMQREALEGANTNTAVLQTMKSAADALKAAHQHMDVDKVHDLMDDI

SEQ ID NO: 2368 - DNA, 561 bp, Acheta domesticus
gagtcctagccgccttggttgcagtatgtttatgggtcttcttccagacactggatcctcgtattcccacctggcagttagattcttctatcattggcacatcacctggcctaggtttccggccaatgccagaagatagcaatgtagagtcaactctcatctggtaccgtggaacagatcgtgatgacttccgtcagtggacagacacccttgatgaatttcttgctgtgtacaagactcctggtctgacccctggtcgaggtcagaacatccacaactgtgactatgataagccgccaaagaaaggccaagtttgcaatgtggacatcaagaattggcatccctgcattcaagagaatcactacaactaccacaagagctctccatgcatattcatcaagctcaacaagatctacaattggatccctgaatactacaatgagagtacgaatttgcctgagcagatgccagaagacctgaagcagtacatccacaacctggagagtaacaactcgagggagatgaacacggtgtgggtgtcgtgcgagggagagaatccag

SEQ ID NO: 2369 - protein, 186 aa, Acheta domesticus
VLAALVAVCLWVFFQTLDPRIPTWQLDSSIIGTSPGLGFRPMPEDSNVESTLIWYRGTDRDDFRQWTDTLDEFLAVYKTPGLTPGRGQNIHNCDYDKPPKKGQVCNVDIKNWHPCIQENHYNYHKSSPCIFIKLNKIYNWIPEYYNESTNLPEQMPEDLKQYIHNLESNNSREMNTVWVSCEGENP

SEQ ID NO: 2370 - DNA, 1079 bp, Acheta domesticus
ggatgaactacagcttttccgaggagatacagttcttcttaaaggaaaaaggaggaaagaaactgtatgcatagtgttatcagatgatacatgtcctgatggaaaaataagaatgaatagagttgtacgcaacaatttacgtgttcgtttgtcagatgttgtatctgtacaaccttgtcctgatgttaagtatggaaaaaggatacatgtactaccaattgatgatacagttgaaggactaaccgggaatttgtttgaggtgtacttaaaaccgtactttctcgaagcataccgacccattcacaaagatgatgcgtttattgttcgtggtggtatgcgagcagtagaattcaaagtagtggaaacagatccttcaccatattgtattgttgctcctgatactgttattcactgtgaaggtgatccaataaaacgtgaagaggaagaagaagcattaaatgctgttggttatgatgacattgggggttgccgaaaacagctagcacagatcaaggaaatggtggaattgccattacggcaccccagtctctttaaggctattggtgttaagccaccgaggggaatactgctgtatggaccccctggaactggtaaaaccctcattgccagggctgtggctaatgaaactggtgcattcttctttttaataaatggtcctgaaattatgagcaagcttgctggtgaatctgaaagcaacttacgtaaggcatttgaagaagctgataagaatgctccggcaattatatttattgatgaactagatgcaattgcccctaaaagagaaaaaactcatggagaggtggaacgtcgcatagtttcacaactactaactttaatggatggtctgaagcaaagttcacatgttattgttatggctgccacaaatagacccaactctattgatggtgccttgcgccgctttggcagatttgatagggaaattgatattggtataccagatgccactggtcgccttgaaattcttcgtatccatactaagaatatgaagttagctgatgatgttgatttggaacagattgcagccgaatcccacggac

SEQ ID NO: 2371 - protein, 359 aa, Acheta domesticus
DELQLFRGDTVLLKGKRRKETVCIVLSDDTCPDGKIRMNRVVRNNLRVRLSDVVSVQPCPDVKYGKRIHVLPIDDTVEGLTGNLFEVYLKPYFLEAYRPIHKDDAFIVRGGMRAVEFKVVETDPSPYCIVAPDTVIHCEGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNAPAIIFIDELDAIAPKREKTHGEVERRIVSQLLTLMDGLKQSSHVIVMAATNRPNSIDGALRRFGRFDREIDIGIPDATGRLEILRIHTKNMKLADDVDLEQIAAESHG

SEQ ID NO: 2372 - DNA, 740 bp, Acheta domesticus
gttcaccggcgatattctgcgcgtgcccgtgtccgaggacatgctgggccgcaccttcaacggcagcggcatccccatcgacggcggcccgcccatcgtcgcagagacctacctcgacgtccagggcatgccgattaatcctcaaacgcgcatctacccggaagaaatgatccagacggggatctcgaccatcgacgtgatgacgtccatcgcgcgagggcagaagatccccatcttctcgggcgcagggctgccacacaacgagatcgctgcgcagatctgccgacaggcggggctggtgcagcacaaggagaacaaggacgacttcgccatcgtgttcgcggcgatgggcgtcaacatggagacggcgcgcttcttcaagcgcgagttcgcgcagacgggcgcgtgcaacgtggtgctgttcctcaacctggccaacgaccccaccatcgagcgcatcatcaccccgcgcctcgcgctcaccgtggccgagttcctggcctaccagtgcaacaagcacgtgctcgtcatcatgaccgacatgacctcctacgcggaggcgctgcgcgaggtgagcgcggcgcgcgaggaggttcctgggcgaagaggcttcccaggctacatgtacaccgatctctccaccatctacgagcgcgctggccgtgtgcaaggccgccccggctccatcactcagatccccatcctgacgatgcccaacgacgacatcacccatcctattc

SEQ ID NO: 2373 - protein, 246 aa, Acheta domesticus
FTGDILRVPVSEDMLGRTFNGSGIPIDGGPPIVAETYLDVQGMPINPQTRIYPEEMIQTGISTIDVMTSIARGQKIPIFSGAGLPHNEIAAQICRQAGLVQHKENKDDFAIVFAAMGVNMETARFFKREFAQTGACNVVLFLNLANDPTIERIITPRLALTVAEFLAYQCNKHVLVIMTDMTSYAEALREVSAAREEVPGRRGFPGYMYTDLSTIYERAGRVQGRPGSITQIPILTMPNDDITHPI

SEQ ID NO: 2374 - DNA, 23 bp, Artificial sequence
  Primer sequence
ggccccaagaagcatttgaagcg

SEQ ID NO: 2375 - DNA, 23 bp, Artificial sequence
  Primer sequence
  misc_feature (18)..(18): n is a, c, g, or t
cgcttgtcccgctcctcngcrat

SEQ ID NO: 2376 - DNA, 27 bp, Artificial sequence
  Primer sequence
gagtttctttagtaaagtattcggtgg

SEQ ID NO: 2377 - DNA, 26 bp, Artificial sequence
  Primer sequence
gcaatgtcatccatcakrtcrtgtac

SEQ ID NO: 2378 - DNA, 22 bp, Artificial sequence
  Primer sequence
gagtcctagccgcvytsgtkgc

SEQ ID NO: 2379 - DNA, 26 bp, Artificial sequence
  Primer sequence
ctggattctctccctcgcamgahacc

SEQ ID NO: 2380 - DNA, 24 bp, Artificial sequence
  Primer sequence
ggatgaactacagctbttccghgg

SEQ ID NO: 2381 - DNA, 23 bp, Artificial sequence
  Primer sequence
gtccgtgggaytcrgchgcaatc

SEQ ID NO: 2382 - DNA, 21 bp, Artificial sequence
  Primer sequence
gttcaccggcgayatyctgcg

SEQ ID NO: 2383 - DNA, 24 bp, Artificial sequence
  Primer sequence
ggaataggatgggtratrtcgtcg

SEQ ID NO: 2384 - DNA, 21 bp, Acheta domesticus
aaagcatggatgttggacaaa

SEQ ID NO: 2385 - DNA, 23 bp, Acheta domesticus
aaagcatggatgttggacaaact

SEQ ID NO: 2386 - DNA, 68 bp, Acheta domesticus
aaaggtattccattcttggtgacccatgatggccgtactatccgttatcctgacccagtcattaaagt

SEQ ID NO: 2387 - DNA, 47 bp, Acheta domesticus
aactgtgaagtaacgaagattgttatgcagcgacttatcaaagttga

SEQ ID NO: 2388 - DNA, 23 bp, Acheta domesticus
aagaagcatttgaagcgtttaaa

SEQ ID NO: 2389 - DNA, 26 bp, Acheta domesticus
aagggtaagggtgtgaaattgagtat

SEQ ID NO: 2390 - DNA, 23 bp, Acheta domesticus
aatgtattcatcattggaaaagc

SEQ ID NO: 2391 - DNA, 22 bp, Acheta domesticus
agaagcatttgaagcgtttaaa

SEQ ID NO: 2392 - DNA, 25 bp, Acheta domesticus
agaagcatttgaagcgtttaaatgc

SEQ ID NO: 2393 - DNA, 23 bp, Acheta domesticus
agtactggcccccacaaattgcg

SEQ ID NO: 2394 - DNA, 26 bp, Acheta domesticus
agtgcagaagaagccaagtacaagct

SEQ ID NO: 2395 - DNA, 22 bp, Acheta domesticus
atcgccgaggagcgggacaagc

SEQ ID NO: 2396 - DNA, 50 bp, Acheta domesticus
caaggacatacttttgccacaagattgaataatgtattcatcattggaaa

SEQ ID NO: 2397 - DNA, 22 bp, Acheta domesticus
cagaagaagccaagtacaagct

SEQ ID NO: 2398 - DNA, 23 bp, Acheta domesticus
catgatggccgtactatccgtta

SEQ ID NO: 2399 - DNA, 32 bp, Acheta domesticus
catgatggccgtactatccgttatcctgaccc

SEQ ID NO: 2400 - DNA, 23 bp, Acheta domesticus
catttgaagcgtttaaatgctcc

SEQ ID NO: 2401 - DNA, 21 bp, Acheta domesticus
cctaaagcatggatgttggac

SEQ ID NO: 2402 - DNA, 23 bp, Acheta domesticus
cctaaagcatggatgttggacaa

SEQ ID NO: 2403 - DNA, 24 bp, Acheta domesticus
cctaaagcatggatgttggacaaa

SEQ ID NO: 2404 - DNA, 26 bp, Acheta domesticus
cctaaagcatggatgttggacaaact

SEQ ID NO: 2405 - DNA, 23 bp, Acheta domesticus
cgtactatccgttatcctgaccc

SEQ ID NO: 2406 - DNA, 38 bp, Acheta domesticus
gaatgtttacctttggtgatttttcttcgcaatcggct

SEQ ID NO: 2407 - DNA, 23 bp, Acheta domesticus
gcagaagaagccaagtacaagct

SEQ ID NO: 2408 - DNA, 23 bp, Acheta domesticus
gcatggatgttggacaaactcgg

SEQ ID NO: 2409 - DNA, 23 bp, Acheta domesticus
gctggtttcatggatgttgtcac

SEQ ID NO: 2410 - DNA, 28 bp, Acheta domesticus
ggccccaagaagcatttgaagcgtttaa

SEQ ID NO: 2411 - DNA, 23 bp, Acheta domesticus
ggtttcatggatgttgtcaccat

SEQ ID NO: 2412 - DNA, 35 bp, Acheta domesticus
tatgatgtgaaaggccgtttcacaattcacagaat

SEQ ID NO: 2413 - DNA, 21 bp, Acheta domesticus
tcattgccaaagggtaagggt

SEQ ID NO: 2414 - DNA, 49 bp, Acheta domesticus
tggatattgccacttgtaaaatcatggaccacatcagatttgaatctgg

SEQ ID NO: 2415 - DNA, 35 bp, Acheta domesticus
ttaaatgctcctaaagcatggatgttggacaaact

SEQ ID NO: 2416 - DNA, 26 bp, Acheta domesticus
tttgaatctggcaacctgtgtatgat

SEQ ID NO: 2417 - DNA, 26 bp, Acheta domesticus
tttgatattgttcatatcaaggatac

SEQ ID NO: 2418 - DNA, 21 bp, Acheta domesticus
aagaaaatcgaacaagaaatc

SEQ ID NO: 2419 - DNA, 23 bp, Acheta domesticus
cagcacatggatgtggacaaggt

SEQ ID NO: 2420 - DNA, 27 bp, Acheta domesticus
gagtttctttagtaaagtattcggtgg

SEQ ID NO: 2421 - DNA, 21 bp, Acheta domesticus
cactacaactaccacaagagc

SEQ ID NO: 2422 - DNA, 22 bp, Acheta domesticus
cagaacatccacaactgtgact

SEQ ID NO: 2423 - DNA, 21 bp, Acheta domesticus
ggtgtgggtgtcgtgcgaggg

SEQ ID NO: 2424 - DNA, 23 bp, Acheta domesticus
tggatccctgaatactacaatga

SEQ ID NO: 2425 - DNA, 22 bp, Acheta domesticus
gagcagtagaattcaaagtagt

SEQ ID NO: 2426 - DNA, 21 bp, Acheta domesticus
gcaattatatttattgatgaa

SEQ ID NO: 2427 - DNA, 21 bp, Acheta domesticus
tcaccatattgtattgttgct

SEQ ID NO: 2428 - DNA, 21 bp, Acheta domesticus
ttgtcctgatgttaagtatgg

SEQ ID NO: 2429 - DNA, 29 bp, Acheta domesticus
acgatgcccaacgacgacatcacccatcc

SEQ ID NO: 2430 - DNA, 23 bp, Acheta domesticus
atgcccaacgacgacatcaccca

SEQ ID NO: 2431 - DNA, 30 bp, Acheta domesticus
atgcccaacgacgacatcacccatcctatt

SEQ ID NO: 2432 - DNA, 22 bp, Acheta domesticus
cagaagatccccatcttctcgg

SEQ ID NO: 2433 - DNA, 24 bp, Acheta domesticus
cggctccatcactcagatccccat

SEQ ID NO: 2434 - DNA, 21 bp, Acheta domesticus
gccaacgaccccaccatcgag

SEQ ID NO: 2435 - DNA, 24 bp, Acheta domesticus
gcccgtgtccgaggacatgctggg

SEQ ID NO: 2436 - DNA, 22 bp, Acheta domesticus
ggcagaagatccccatcttctc

SEQ ID NO: 2437 - DNA, 21 bp, Acheta domesticus
gttcaccggcgatattctgcg

SEQ ID NO: 2438 - DNA, 22 bp, Acheta domesticus
gttcaccggcgatattctgcgc

SEQ ID NO: 2439 - DNA, 22 bp, Acheta domesticus
ataaatggtcctgaaattatga

SEQ ID NO: 2440 - DNA, 23 bp, Acheta domesticus
gtcaacatggagacggcgcgctt

SEQ ID NO: 2441 - DNA, 21 bp, Acheta domesticus
cccgctggtttcatggatgtt

SEQ ID NO: 2442 - DNA, 24 bp, Acheta domesticus
gacaacatccatgaaaccagcggg

SEQ ID NO: 2443 - DNA, 22 bp, Acheta domesticus
ttcatggatgttgtcaccattg

SEQ ID NO: 2444 - DNA, 23 bp, Acheta domesticus
gaagaagccaagtacaagctctg

SEQ ID NO: 2445 - DNA, 22 bp, Acheta domesticus
aagaagccaagtacaagctctg

SEQ ID NO: 2446 - DNA, 23 bp, Acheta domesticus
gccaagtacaagctctgcaaggt

SEQ ID NO: 2447 - DNA, 25 bp, Acheta domesticus
gccaagtacaagctctgcaaggtca

SEQ ID NO: 2448 - DNA, 21 bp, Acheta domesticus
agtacaagctctgcaaggtca

SEQ ID NO: 2449 - DNA, 27 bp, Acheta domesticus
tatggaccccctggaactggtaaaacc

SEQ ID NO: 2450 - DNA, 28 bp, Acheta domesticus
tgcccgtgtccgaggacatgctgggccg

SEQ ID NO: 2451 - DNA, 29 bp, Acheta domesticus
tgcccgtgtccgaggacatgctgggccgc

SEQ ID NO: 2452 - DNA, 26 bp, Acheta domesticus
cgtgtccgaggacatgctgggccgca

SEQ ID NO: 2453 - DNA, 23 bp, Acheta domesticus
atgggcgtcaacatggagacggc

SEQ ID NO: 2454 - DNA, 21 bp, Acheta domesticus
tggagacggcgcgcttcttca

SEQ ID NO: 2455 - DNA, 26 bp, Acheta domesticus
ttcctcaacctggccaacgaccccac

SEQ ID NO: 2456 - DNA, 32 bp, Acheta domesticus
accatcgagcgcatcatcaccccgcgcctcgc

SEQ ID NO: 2457 - DNA, 23 bp, Acheta domesticus
tccaccatctacgagcgcgctgg

SEQ ID NO: 2458 - DNA, 26 bp, Acheta domesticus
ctgacgatgcccaacgacgacatcac

SEQ ID NO: 2459 - DNA, 23 bp, Acheta domesticus
atgcccaacgacgacatcaccca

SEQ ID NO: 2460 - DNA, 23 bp, Acheta domesticus
tgggtgatgtcgtcgttgggcat

SEQ ID NO: 2461 - DNA, 583 bp, Acheta domesticus
gctcctaaagcatggatgttggacaaactcggaggagtattcgctcctcgccccagtactggcccccacaaattgcgtgaatgtttacctttggtgatttttcttcgcaatcggctcaagtatgctctgacgaactgtgaagtaacgaagattgttatgcagcgacttatcaaagttgacggcaaggtgcgaaccgatccgaattatcccgctggtttcatggatgttgtcaccattgagaagactggagagttcttcaggctggtgtatgatgtgaaaggccgtttcacaattcacagaattagtgcagaagaagccaagtacaagctctgcaaggtcaggagagttcaaactgggccaaaaggtattccattcttggtgacccatgatggccgtactatccgttatcctgacccagtcattaaagttaatgactcaatccaattggatattgccacttgtaaaatcatggaccacatcagatttgaatctggcaacctgtgtatgattactggtggacgtaacttgggtcgagtggggactgttgtgagtcgagaacgtcacccaggctcgtttgatattg

SEQ ID NO: 2462 - DNA, 44 bp, Artificial sequence
  Primer sequence
gcgtaatacgactcactatagggctcctaaagcatggatgttgg

SEQ ID NO: 2463 - DNA, 22 bp, Artificial sequence
  Primer sequence
caatatcaaacgagcctgggtg

SEQ ID NO: 2464 - DNA, 22 bp, Artificial sequence
  Primer sequence
gctcctaaagcatggatgttgg

SEQ ID NO: 2465 - DNA, 44 bp, Artificial sequence
  Primer sequence
gcgtaatacgactcactataggcaatatcaaacgagcctgggtg

SEQ ID NO: 2466 - DNA, 335 bp, Acheta domesticus
gaagaaagatggaaaggctccgaccactggtgaggccattcagaaactcagagaaacagaagaaatgttaatcaaaaagcaggaatttttagagaagaaaatcgaacaagaaatcaatgttgcaaagaaaaatggaacgaaaaataagcgagctgctattcaggctctgaaaaggaaaaagaggtatgaaaaacaattgcagcaaattgatggcaccttatccacaattgaaatgcaaagagaagctttggagggtgctaatactaatacagctgtattacaaacaatgaaatcagcagcagatgcccttaaagcagctcatcagcacatggatg

SEQ ID NO: 2467 - DNA, 46 bp, Artificial sequence
  Primer sequence
gcgtaatacgactcactatagggaagaaagatggaaaggctccgac

SEQ ID NO: 2468 - DNA, 22 bp, Artificial sequence
  Primer sequence
catccatgtgctgatgagctgc

SEQ ID NO: 2469 - DNA, 24 bp, Artificial sequence
  Primer sequence
gaagaaagatggaaaggctccgac

SEQ ID NO: 2470 - DNA, 44 bp, Artificial sequence
  Primer sequence
gcgtaatacgactcactataggcatccatgtgctgatgagctgc

SEQ ID NO: 2471 - DNA, 495 bp, Acheta domesticus
gtcttcttccagacactggatcctcgtattcccacctggcagttagattcttctatcattggcacatcacctggcctaggtttccggccaatgccagaagatagcaatgtagagtcaactctcatctggtaccgtggaacagatcgtgatgacttccgtcagtggacagacacccttgatgaatttcttgctgtgtacaagactcctggtctgacccctggtcgaggtcagaacatccacaactgtgactatgataagccgccaaagaaaggccaagtttgcaatgtggacatcaagaattggcatccctgcattcaagagaatcactacaactaccacaagagctctccatgcatattcatcaagctcaacaagatctacaattggatccctgaatactacaatgagagtacgaatttgcctgagcagatgccagaagacctgaagcagtacatccacaacctggagagtaacaactcgagggagatgaacacg

SEQ ID NO: 2472 - DNA, 47 bp, Artificial sequence
  Primer sequence
gcgtaatacgactcactatagggtcttcttccagacactggatcctc

SEQ ID NO: 2473 - DNA, 22 bp, Artificial sequence
  Primer sequence
cgtgttcatctccctcgagttg

SEQ ID NO: 2474 - DNA, 25 bp, Artificial sequence
  Primer sequence
gtcttcttccagacactggatcctc

SEQ ID NO: 2475 - DNA, 44 bp, Artificial sequence
  Primer sequence
gcgtaatacgactcactataggcgtgttcatctccctcgagttg

SEQ ID NO: 2476 - DNA, 776 bp, Acheta domesticus
gttgaaggactaaccgggaatttgtttgaggtgtacttaaaaccgtactttctcgaagcataccgacccattcacaaagatgatgcgtttattgttcgtggtggtatgcgagcagtagaattcaaagtagtggaaacagatccttcaccatattgtattgttgctcctgatactgttattcactgtgaaggtgatccaataaaacgtgaagaggaagaagaagcattaaatgctgttggttatgatgacattgggggttgccgaaaacagctagcacagatcaaggaaatggtggaattgccattacggcaccccagtctctttaaggctattggtgttaagccaccgaggggaatactgctgtatggaccccctggaactggtaaaaccctcattgccagggctgtggctaatgaaactggtgcattcttctttttaataaatggtcctgaaattatgagcaagcttgctggtgaatctgaaagcaacttacgtaaggcatttgaagaagctgataagaatgctccggcaattatatttattgatgaactagatgcaattgcccctaaaagagaaaaaactcatggagaggtggaacgtcgcatagtttcacaactactaactttaatggatggtctgaagcaaagttcacatgttattgttatggctgccacaaatagacccaactctattgatggtgccttgcgccgctttggcagatttgatagggaaattgatattggtataccagatgccactggtcgccttgaaattct

SEQ ID NO: 2477 - DNA, 46 bp, Artificial sequence
  Primer sequence
gcgtaatacgactcactatagggttgaaggactaaccgggaatttg

SEQ ID NO: 2478 - DNA, 22 bp, Artificial sequence
  Primer sequence
agaatttcaaggcgaccagtgg

SEQ ID NO: 2479 - DNA, 24 bp, Artificial sequence
  Primer sequence
gttgaaggactaaccgggaatttg

SEQ ID NO: 2480 - DNA, 44 bp, Artificial sequence
  Primer sequence
gcgtaatacgactcactataggagaatttcaaggcgaccagtgg

SEQ ID NO: 2481 - DNA, 469 bp, Acheta domesticus
acccggaagaaatgatccagacggggatctcgaccatcgacgtgatgacgtccatcgcgcgagggcagaagatccccatcttctcgggcgcagggctgccacacaacgagatcgctgcgcagatctgccgacaggcggggctggtgcagcacaaggagaacaaggacgacttcgccatcgtgttcgcggcgatgggcgtcaacatggagacggcgcgcttcttcaagcgcgagttcgcgcagacgggcgcgtgcaacgtggtgctgttcctcaacctggccaacgaccccaccatcgagcgcatcatcaccccgcgcctcgcgctcaccgtggccgagttcctggcctaccagtgcaacaagcacgtgctcgtcatcatgaccgacatgacctcctacgcggaggcgctgcgcgaggtgagcgcggcgcgcgaggaggttcctgggcgaagaggcttcccaggctacat

SEQ ID NO: 2482 - DNA, 44 bp, Artificial sequence
  Primer sequence
gcgtaatacgactcactataggacccggaagaaatgatccagac

SEQ ID NO: 2483 - DNA, 22 bp, Artificial sequence
  Primer sequence
atgtagcctgggaagcctcttc

SEQ ID NO: 2484 - DNA, 22 bp, Artificial sequence
  Primer sequence
acccggaagaaatgatccagac

SEQ ID NO: 2485 - DNA, 44 bp, Artificial sequence
  Primer sequence
gcgtaatacgactcactataggatgtagcctgggaagcctcttc

SEQ ID NO: 2486 - DNA, 3431 bp, Leptinotarsa decemlineata
gggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccgaacccagctttcttgtacaaagtggtgatatcccgcgggatcagaagcaacctcatggaaatgatgaggtaaggtttcatactcttgcctcttcttacggctttctgtgtcttcactgtaagtttctatgatttgagccaccaatatatatgctctggtgtgctgagttatgtttatctggtcacgcttagtgggtaaaattatgcttattttagcataaactttaatgagattaggttttgtatcacaccgatctttagttgtttagtaagatgacagaaattcttggtaaaacactctaaatcgtcttctttagtgaagttttccttagagtagcataaattttggcttttttcttgatggttgaataaggtggcacttgttggtatgagactttattgagagtcatattaagctgatccacgcgtttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgccggatcagcttagcgttcattgaatttgatggccataggggtttagatgcaactgtttctttgaacattgtagaaatatataaagattttacattagcctactcttgaaagtcaaattgtcgaatttgattatattatactctagaggtgatattagttaatgagtttatactcggttatttacagcttattcatataccagttaacgtgtctcatatattctaacttcttagcatttaacgtgtttgcaggtcagcttgacactgaacataacagcatcactagtgcggccgcctgcaggtcgaccatatggtcgacctgcaggcggccgcactagtgatataccactttgtacaagaaagctggtcgaattcgccctttcggacagactcgttcatttcccccaacacatcgaaagcggcctctacgccatcctctgcgacttgattgttctccctggccttctgaacttgctccgaatcataagaaaggatgaagtagctgtcctccgttgcgagacagactaattttccactgtcagaccaataaaccgccctcggttgtatttcaatccgtctcaccaagtccaaagtttcccaatcgtaaaacgttaaaccggacaccgatttaatccccaagagaaaacccccgtagattccttccgcgctgaaatccgacttgaagttcttcctttctttgaagtttttgaatatccgaattgtggaaccagactcgcgaatggcatactcgctggagtcctgagcccagacaaactcttgagcgcttccaaaagccttgttccgtagagccatcgctgtgtaaatgatatattcgccgtctccgcatactacaacgaatcttccattcggattatgttggattgtttgagggtatatttcacatgctcccatatcttttacagagacaggtaaacgctccccatctcttatttctccaccttctggcagcgccttcaaattagcttgttgtaattccgagtgccttgcccaaattattttaccgccactggcatccatactaactgccggttcttctcttccaactttcactaatatactgccctcgtcataccccagagaaacattattcgaacccttcaagcaacaaatggtccacactctctcgaacccataattcaaacaattctctaatctgtgtgtattcgtatgccaaactctaacggtaccatcttcgctgcctgtgagagccacaggtagttcagggtggaaacaaaccgcggttacgttttgggcgtgtccttccaaggtttggacacacgttttgttttgatagtcccagattttaaccaaccgatcgtctgctccc

What is claimed is:

1. An isolated double stranded RNA molecule comprising annealed complementary strands, wherein at least one of said strands comprises a polyribonucleotide selected from the group consisting of:
   (i) polyribonucleotides complementary to at least 50 contiguous nucleotides of the target gene of SEQ ID NO: 3,
   (ii) polyribonucleotides complementary to at least 50 contiguous nucleotides of a target gene encoding the amino acid sequence of SEQ ID NO: 4, and
   (iii) polyribonucleotides having at least 90% sequence identity with the polyribonucleotides of (i) or (ii), wherein said double stranded RNA molecule has pesticidal activity.

2. A polynucleotide or set of polynucleotides encoding a double stranded RNA molecule according to claim 1.

3. The double stranded RNA molecule of claim 1, wherein ingestion of said double stranded RNA molecule by a plant insect pest inhibits the growth of said insect pest.

4. The double stranded RNA molecule of claim 1, wherein ingestion of said double stranded RNA molecule inhibits expression of a nucleotide sequence substantially complementary to said polyribonucleotide.

5. A cell transformed with a polynucleotide encoding a double stranded RNA molecule according to claim 1.

6. The cell of claim 5, wherein said cell is a plant cell.

7. A plant transformed with a polynucleotide encoding a double stranded RNA molecule according to claim 1.

8. The plant of claim 7, wherein said double stranded RNA molecule inhibits a pest biological activity.

9. The plant of claim 7, wherein said double stranded RNA molecule inhibits expression of a target gene.

10. The plant of claim 9 wherein said target gene is an insect, nematode or fungal gene.

11. The plant of claim 7, wherein said plant is cytoplasmic male sterile.

12. The plant of claim 7, wherein said plant further comprises or expresses a pesticidal agent selected from the group consisting of a patatin, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

13. The plant of claim 12 wherein said *Bacillus thuringiensis* insecticidal protein is selected from the group consisting of a Cry1, a Cry3, a TIC851, a CryET170, a Cry22, a binary insecticidal protein CryET33 and CryET34, a binary insecticidal protein CryET80 and CryET76, a binary insecticidal protein TIC100 and TIC101, and a binary insecticidal protein PS149B1.

14. The plant of claim 7, wherein said plant selected from the group consisting of alfalfa, apple, apricot, artichoke, asparagus, avocado, banana, barley, beans, beet, blackberry, blueberry, broccoli, Brussels sprouts, cabbage, canola, carrot, cassava, cauliflower, a cereal, celery, cherry, citrus, clementine, coffee, corn, cotton, cucumber, eggplant, endive, eucalyptus, figs, grape, grapefruit, groundnuts, ground cherry, kiwifruit, lettuce, leek, lemon, lime, pine, maize, mango, melon, millet, mushroom, nut, oat, okra, onion, orange, an ornamental plant or flower or tree, papaya, parsley, pea, peach, peanut, peat, pepper, persimmon, pineapple, plantain, plum, pomegranate, potato, pumpkin, radicchio, radish, rapeseed, raspberry, rice, rye, sorghum, soy, soybean, spinach, strawberry, sugar beet, sugarcane, sunflower, sweet potato, tangerine, tea, tobacco, tomato, a vine, watermelon, wheat, yams and zucchini.

15. The plant of claim 6, wherein said plant is resistant against infestation by an insect selected from the group consisting of *Leptinotarsa* spp., *Lema* spp., *Epitrix* spp., *Epicauta* spp., *Epilachna* spp., *Phaedon* spp., *Nilaparvata* spp., *Laodelphax* spp., *Nephotettix* spp., *Sogatella* spp., *Acheta* spp., *Blissus* spp., *Scotinophora* spp., *Acrosternum* spp., *Parnara* spp., *Chilo* spp., *Chilotraea* spp., *Sesamia* spp., *Tryporyza* spp., *Cnaphalocrocis* spp., *Agromyza* spp., *Diatraea* spp., *Narnaga* spp., *Xanthodes* spp., *Spodoptera* spp., *Mythimna* spp., *Helicoverpa* spp., *Colaspis* spp., *Lissorhoptrus* spp., *Echinocnemus* spp., *Diclodispa* spp., *Oulema* spp., *Sitophilus* spp., *Pachydiplosis* spp., *Hydrellia* spp., *Chlorops* spp., *Diabrotica* spp., *Ostrinia* spp., *Agrotis* spp., *Elasmopalpus* spp., *Melanotos* spp., *Cyclocephala* spp., *Popillia* spp., *Chaetocnema* spp., *Sphenophorus* spp., *Rhopalosiphum* spp., *Anuraphis* spp., *Melanoplus* spp., *Hylemya* spp., *Anaphothrips* spp., *Solenopsis* spp., *Helicoverpa* spp., *Pectinophora* spp., *Iianas* spp., *Heliothis* spp., *Anthonomus* spp., *Pseudatomoscelis* spp., *Trialeurodes* spp., *Bemisia* spp., *Aphis* spp., *Lygus* spp., *Euschistus* spp., *Chlorochroa* spp., *Nezara* spp., *Thrips* spp., *Frankliniella* spp., *Empoasca* spp., *Myzus* spp., *Paratrioza* spp., *Conoderus* spp., *Phthorimaea* spp., *Macrosiphum* spp., *Thyanta* spp., *Phthorimaea* spp., *Helicoverpa* spp., *Keiferia* spp., *Limonius* spp., *Manduca* spp., *Liriomyza* spp., *Drosophilia* spp., *Carabus* spp., *Chironomus* spp., *Ctenocephalides* spp., *Diaprepes* spp., *Ips* spp., *Tribolium* spp., *Glossina* spp., *Anopheles* spp., *Helicoverpa* spp., *Acyrthosiphon* spp., *Apis* spp., *Homalodisca* spp., *Aedes* spp., *Bombyx* spp., *Locusta* spp., *Boophilus* spp., *Acanthoscurria* spp., *Diploptera* spp., *Heliconius* spp., *Curculio* spp., *Plutella* spp., *Amblyomma* spp., *Anteraea* spp., and *Armigeres* spp..

16. A seed, part, tissue, or cell of the plant of claim 7, wherein said seed, part, tissue or cell comprises a double stranded RNA molecule according to claim 1.

17. A product produced from the plant of claim 7, wherein said product comprises said double stranded RNA molecule.

18. The product of claim 17, wherein said product is selected from the group consisting of food, feed, fiber, paper, meal, protein, starch, flour, silage, coffee, tea, and oil.

19. A pesticide comprising the product of claim 17, said product expressing said double stranded RNA molecule.

20. A method for controlling or preventing insect growth comprising providing an insect pest with a product of a plant transformed with a polynucleotide encoding the double stranded RNA molecule of claim 1.

21. A method for producing a plant resistant against a plant pathogenic organism comprising:
a) transforming a plant cell with a polynucleotide encoding the double stranded RNA molecule of claim 1,
b) regenerating a plant from the transformed plant cell; and
c) growing the transformed plant under conditions suitable for the expression of said double stranded RNA molecule,
wherein said grown transformed plant is resistant to said plant pathogenic organism compared to an untransformed plant.

22. A method for improving yield, comprising:
a) transforming a plant cell with a polynucleotide encoding the double stranded RNA molecule of claim 1,
b) regenerating a plant from the transformed plant cell; and
c) growing the transformed plant under conditions suitable for the expression of said double stranded RNA molecule from said polynucleotide,
wherein said expression inhibits feeding by a plant pathogenic organism and reduces loss of yield due to pest infestation.

23. A transgenic plant resistant to an insect pest comprising the double stranded RNA molecule of claim 1.

24. The transgenic plant according to claim 23 further comprising or expressing a pesticidal agent selected from the group consisting of a patatin, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphearicus* insecticidal protein.

25. The transgenic plant of claim 24 wherein said *Bacillus thuringiensis* insecticidal protein is selected from the group consisting of a Cry1, a Cry3, a TIC851, a CryET170, a Cry22, a binary insecticidal protein CryET33 and CryET34, a binary insecticidal protein CryET80 and CryET76, a binary insecticidal protein TIC100 and TIC101, and a binary insecticidal protein PS149B1.

26. A pesticide comprising a plant of claim 7 or a seed, part, tissue, or cell thereof, wherein said plant, seed, part, tissue or cell thereof expresses said double stranded RNA molecule.

27. A method for controlling or preventing insect growth comprising providing an insect pest with a plant transformed with a polynucleotide encoding the double stranded RNA molecule of claim 1.

28. The method according to claim 27, wherein the insect pest is selected from the group consisting of *Leptinotarsa* spp., *Tribolium* spp., *Myzus* spp., *Nilaparvata* spp., *Chilo* spp., and *Acheta* spp.

29. The method according to claim 28, wherein the insect pest is selected from the group consisting of *Leptinotarsa decemlineata*, *Tribolium castaneum*, *Myzus persicae*, *Nilaparvata lugens*, *Chilo suppressalis*, and *Acheta domesticus*.

30. The plant of claim 15, wherein said plant is resistant against infestation by an insect selected from the group consisting
of *Leptinotarsa decemlineata* (Colorado potato beetle), *Leptinotarsa juncta* (false potato beetle), *Leptinotarsa texana* (Texan false potato beetle), *Lema trilineata* (three-lined potato beetle), *Epitrix cucumeris* (potato flea beetle), *Epitrix hirtipennis* (flea beetle), *Epitrix tuberis* (tuber flea beetle), *Epicauta vittata* (striped blister beetle),
*Epilachna varivetis* (mexican bean beetle), *Phaedon cochieariae* (mustard leaf beetle), *Nitaparvata lugens* (brownplanthopper), *Laodelphax striatellus* (small brown planthopper), *Nephoteltix virescens*, *Nephotettix cincticeps* (green leafhopper), *Nephotettik nigropictus* (rice leafhopper), *Sogatella furcifera* (white-backed planthopper), *Acheta domesticus* (house cricket), *Blis-* sus leucopterus leucopterus (chinch bug), *Scotinophora vermidulate* (rice blackbug), *Acrosternum hilare* (green stink bug), *Parnara guttata* (rice skipper), *Chilo suppressalis* (rice striped stem borer), *Chilo auricilius* (gold-fringed stem borer), *Chilo polychrysus* (dark-headed stem borer), *Chilotraea polychrysa* (rice stalk borer), *Sesamia inferens* (pink rice borer), *Tryporyza innotata* (white rice borer), *Tryporyza incertulas* (yellow rice borer), *Cnaphalocrocis medinalis* (rice leafroller), *Agromyza oryzae* (leafminer), *Agromyza parvicornis* (corn blot leafminer), *Diatraea saccharalis* (sugarcane borer), *Diatraea grandiosella* (southwestern corn borer), *Narnaga aenescens* (green rice caterpillar), *Xanthodes transversa* (green caterpillar), *Spodoptera frugiperda* (fall armyworm), *Spodoptera exigua* (beet armyworm), *Spodoptera littoralis* (climbing cutworm), *Spodoptera praefica* (western yellow-striped armyworm), *Helicoverpa zea* (corn earworm), *Colaspis brunnea* (grape colaspis), *Lissorhoptrus oryzophilus* (rice water weevil), *Echinocnemus squamos* (rice plant weevil), *Diciodispa armigera* (rice hispa), *Oulema oryzae* (leaf beetle), *Sitophilus oryzae* (rice weevil), *Pachydiplosis oryzae* (rice gall midge), *Hydrellia griseola* (small rice leafminer), and *Hydrellia sasakii* (rice stem maggot), *Chlorops oryzae* (stem maggot), *Diabrotica virgifera virgifera* (western corn rootworm), *Diabrotica barberi* (northern corn rootworm), *Diabrotica undecimpunctala howardi* (southern corn rootworm), *Diabrotica virgifera zeae* (Mexican corn rootworm); *Diabrotica balteata* (banded cucumber beetle), *Ostrinia nubilalis* (European corn borer), *Agrotis ipsilon* (black cutworm), *Elasmopalpus lignosellus* (lesser cornstalk borer), *Melanotus* wireworms, *Cyclocephaia borealis* (northern masked chafer), *Cyclocephala immaculata* (southern masked chafer), *Popillia japonica* (Japanese beetle), *Chaetocnema pulicaria* (corn flea beetle), *Sphenophorus maidis* (maize billbua), *Rhopalosiphum maidis* (corn leaf aphid), *Anuraphis maidiradicis* (corn root aphid), *Melanoplus femurrubrum* (redlegged grasshopper), *Melanoplus differentialis* (differential grasshopper), *Melanoplus sanguinipes* (migratory grasshopper), *Hylemya platura* (seedcorn maggot), *Anaphothrips obscrurus* (grass thrips), *Solenopsis milesta* (thief ant), *Helicoverpa zea* (cotton bollworm), *Helicoverpa armigera* (American bollworm)), *Pectinophora gossypiella* (pink bollworm), *Heliothis virescens* (tobacco budworm), *Anthonomus grandis* (boll weevil), *Pseudatomoscelis seriatus* (cotton fleahopper), *Trialeurodes abutiloneus* (banded-winged whitefly), *Trialeurodes vaporariorum* (greenhouse whitefly), *Bemisia argentifoln* (silverleaf whitefly), *Aphis gossypii* (cotton aphid), *Lygus lineolaris* (tarnished plant bug), *Lygus hesperus* (western tarnished plant bug), *Euschistus conspersus* (consperse stink bug), *Chlorochroa sayi* (Say stinkbug), *Nezara viridula* (southern green stinkbug), *Thrips tabaci* (onion thrips), *Frankliniella fusca* (tobacco thrips), *Frankliniella occidentalis* (western flower thrips), *Empoasca fabae* (potato leafhopper), *Myzus persicae* (green peach aphid), *Paratrioza cockerelli, Conoderus falli* (southern potato wireworm), and *C. vespertinus* (tobacco wireworm), *Phthorimaea operculella* (potato tuberworm), *Macrosiphum euphorbiae* (potato aphid), *Thyanta pallidovirens* (redshouldered stinkbug), *Phthorimaea operculella* (potato tuberworm), *Helicoverpa zea* (tomato fruitworm), *Keiferia lycopersicella* (tomato pinworm), *Limonius* wireworms, *Manduca sexta* (tobacco hornworm), and *M. quinquemaculata* (tomato hornworm), *Liriomyza sativae, L. trifolii, L. huldobrensis* (leafminer), *Drosophilla melanogaster, D. yakuba, D. pseudoobscura, D. simulans*), *Carabus granulatus, Chironomus tentanus, Ctenocephalides felis* (cat flea), *Diaprepes abbreviates* (root weevil), *Ips pini* (pine engraver), *Tribolium castaneum* (red floor beetle), *Glossina morsitans* (tsetse fly), *Anopheles gambiae* (malaria mosquito), *Helicoverpa armigera* (African Bollworm), *Acyrthosiphon pisum* (pea aphid), *Apis melifera* (honey bee), *Homalodisca coagulate* (glassy-winged sharpshooter), *Aedes aegypti* (yellow fever mosquito), *Bombyx mori* (silkworm)), *Locusta migratoria* (migratory locust), *Boophilus microlus* (cattle tick), *Acanthoscurria gomesiane* (red-haired chololate bird eater). *Diploptera punctala* (pacific beetle cockroach), *Heliconius erato* (red passion flower butterfly), *H. melpomene* (postman butterfly)), *Curculio glandium* (acorn weevil), *Plutella xylostella* (diamontback moth), *Amblyomma variegatum* (cattle tick), *Anteraea yamamai* (silkmoth), and *Armigeres subalbatus*.

\* \* \* \* \*